(12) United States Patent
Bunkers et al.

(10) Patent No.: US 7,332,596 B1
(45) Date of Patent: Feb. 19, 2008

(54) ANTIFUNGAL PROTEINS AND METHODS FOR THEIR USE

(75) Inventors: Greg J. Bunkers, Wildwood, MO (US); Jihong Liang, Chesterfield, MO (US); Cindy A. Mittanck, Ballwin, MO (US); Jeffrey W. Seale, Ballwin, MO (US); Yonnie S. Wu, Vacaville, CA (US)

(73) Assignee: Monsanto Technology LLC, St. Louis, MO (US)

( * ) Notice: Subject to any disclaimer, the term of this patent is extended or adjusted under 35 U.S.C. 154(b) by 306 days.

(21) Appl. No.: 10/421,684

(22) Filed: Apr. 23, 2003

Related U.S. Application Data

(62) Division of application No. 09/732,210, filed on Dec. 7, 2000, now Pat. No. 6,573,361.

(60) Provisional application No. 60/169,513, filed on Dec. 7, 1999, provisional application No. 60/169,340, filed on Dec. 7, 1999.

(51) Int. Cl.
*C07H 21/04* (2006.01)
*C12N 5/10* (2006.01)

(52) U.S. Cl. .................. 536/23.7; 435/6; 435/69.1; 435/254.7; 435/252.3; 435/320.1; 530/300; 530/324

(58) Field of Classification Search .............. 536/23.6, 536/23.7; 435/6, 254.7, 69.1, 252.3, 320.1; 530/324, 300
See application file for complete search history.

(56) References Cited

U.S. PATENT DOCUMENTS

| | | | |
|---|---|---|---|
| 5,773,696 | A | 6/1998 | Liang et al. |
| 6,573,361 | B1 * | 6/2003 | Bunkers et al. ............. 530/324 |

OTHER PUBLICATIONS

Sosa et al., Structure of a ribosomal protein gene in *Mucor racemosus*, Nucleic Acids Research *17*:9319-9331 (1989).

* cited by examiner

*Primary Examiner*—Chih-Min Kam
(74) *Attorney, Agent, or Firm*—Timothy K. Ball, Esq.

(57) ABSTRACT

A novel protein was isolated from *Fusarium culmorum* and characterized. The protein, termed FCWP1, demonstrated significant antifungal activity against several fungal species. Mutations in proteolytic consensus sequences contained within FCWP1 improved the stability of its antifungal activity. In addition, a class of proteins related to FCWP1 was identified and characterized. This class is made up of ribosomal proteins and displayed similar values for pI and molecular weight. A representative number of proteins from this class were tested and found to have significant antifungal activities.

The antifungal proteins disclosed herein are useful in controlling fungal infections in plants. Transgenic plants may be produced that are more resistant to fungal infections relative to non-transgenic plants of the same species. Alternatively, the proteins may be applied to plants exogenously.

20 Claims, 7 Drawing Sheets

```
GGGGGGGGGGGGGTGACAANTTCATCAACGAAACGATNTCACCCCCAGTTTTCCAC
CGTCAACACACCCAGAGACCATCACGACAATCGGCAAAAATGGCGACAACGACTCTCCCGTCACC
                                  M  A  D  N  D  S  P  V  T
CTCCGAACTCGCAAGTTCATCCGCAACCCTCTGCTGGGCCGTAAGCAGATGGTCGTTGACATCCTC
 L  R  T  R  K  F  I  R  N  P  L  L  G  R  K  Q  M  V  V  D  I  L
CACCCCAACCGTGCCAACATCTCCAAGGAGGAGCTCCGCGAGAAGCTCGGTTCCCCTACAAGGCC
 H  P  N  R  A  N  I  S  K  E  E  L  R  E  K  L  G  S  P  Y  K  A
CAGAAGGACCAGATCTCCGTCTTCGGTCTCCGAACCCAGTTCGGTGGCAAGACCACCGGCTTC
 Q  K  D  Q  I  S  V  F  G  L  R  T  Q  F  G  G  G  K  T  T  G  F
GCTCTCGTCTATGACTCCCCCGAGGCCATGAAGAAGTTCGAGCCTCAGTACCGATTGGTGCGCGTT
 A  L  V  Y  D  S  P  E  A  M  K  K  F  E  P  Q  Y  R  L  V  R  V
GGCCTCGCCACCAAGGCCGAGCGTGCTTCCCGACAGCAGCGCAAGAACGACAAAAG
 G  L  A  T  K  A  E  R  A  S  R  Q  Q  R  K  N  R  Q  K
ACTCTCCGAGGTACGGCAAAGTCAAGGGTGCCAAGGCGAAGAAGGAGAAATAAACGATTCATGGC
 T  L  R  G  T  A  K  V  K  G  A  K  A  K  K  E  K  *
TTGGCTTGTGTATATCCTCGGGCTGCTGGTTGGGGAGCGGCTGCTGCTGCTATGTCTGCAGCTGCCTGCATT
CGGTGGTCATGCGGGTGCGTCCATTACTACGGTCCATCCTCGTCGTCGGCGTCGGCTTTGGCATA
GGGTACAGGGACTTGCTGGCGGACGCGGGGCTATCTGGACTCGACGAGGGGGTTGAAGGCTACG
CTTTCACCTTCCTTGCTCAATACACTAGCATGAAATCAATGGTGTTTTTCGGGTTTTCGGACCAAAA
ACAAAAAATAGCAATGTCTCTGGTTTTCACGAAAAAAAAAAAAAAAAAAA
```

Figure 3

```
RPG19  MNDQPWMDSEWMQKMRTKRADAAVTIRTRKFLTNRLLQRK
FCWP              MADN..DSPVTLRTRKFIRNPLLGRK
                      *  *  ** ***** ***** ***

RPG19  QMVVDVIHPGLANVSKDELRSKIGKMYKADKEVVSVFGFKT
FCWP   QMVVDILHPNRANISKEELREKLGSPYKAQKDQISVFGLRT
       ****** ** ** **** **** *   **  ** ****  *

RPG19  HFGGGKTTGFALIYDNVEALKNFEPKHRLVRIGLA.EAPKG
FCWP   QFGGGKTTGFALVYDSPEAMKKFEPQYRLVRVGLATKAERA
        *********** ** **  * ****  **** ***  *

RPG19  GRKQRKEKKNREKKFRG...VRKSKKPRKE*
FCWP   SRQQRKQRKNRQKTLRGTAKVKGAKAKKEK*
        * *** ***  ***    *    * **

Figure 4
```

ANTIFUNGAL PROTEINS AND METHODS FOR THEIR USE

This application is a divisional of U.S. application Ser. No. 09/732,210, filed Dec. 7, 2000, now U.S. Pat. No. 6,573,361, which claims priority of U.S. Provisional Application No. 60/169,340, filed Dec. 7, 1999, and U.S. Provisional Application No. 60/169,513, filed Dec. 7, 1999.

FIELD OF THE INVENTION

The present invention relates to antifungal proteins and methods for their use. Specifically, the invention discloses novel antifungal proteins, nucleic acid sequences encoding the antifungal proteins, transformed host cells and transgenic plants expressing the antifungal proteins and useful for producing the antifungal proteins, as well as compositions containing the antifungal proteins. Methods are also disclosed for preparing the transformed host cells and transgenic plants.

INCORPORATION OF SEQUENCE LISTING

This application contains a sequence listing, which is contained on three identical CD-ROMs: two copies of a sequence listing (Copy 1 and Copy 2) and a sequence listing Computer Readable Form (CRF), all of which are herein incorporated by reference. All three CD-ROMs each contain one file called "SequenceListing_38-21(15036)C_v_Mar_30_2006.txt" which is 1,822,269 bytes in size and was created on Mar. 29, 2006.

BACKGROUND OF THE INVENTION

Protection of important crops from disease is a paramount objective of the agricultural industry because fungal infections cause significant economic losses in crops. Many plants have developed natural resistance to some pathogenic fungi. However, natural plant defenses often do not provide sufficient protection against fungal disease.

Fungi of multiple genera may cause disease or damage in plants. These genera include *Alternaria, Ascochyta, Aspergillus, Botrytis, Cercospora, Colletotrichum, Diplodia, Erysiphe, Fusarium, Gaeumanomyces, Helminthosporium, Macrophomina, Mycosphaerella, Nectria, Peronospora, Phoma, Phymatotrichum, Phytophthora, Plasmopara, Podosphaera, Puccinia, Puthium, Pyrenophora, Pyricularia, Pythium, Rhizoctonia, Scerotium, Sclerotinia, Septoria, Thielaviopsis, Uncinula, Venturia,* and *Verticillium*.

Many chemical fungicidal compounds have been developed to combat these various fungal pathogens. Examples of chemical antifungal agents include polyoxines, nikkomycines, carboxyamides, aromatic carbohydrates, carboxines, morpholines, inhibitors of sterol biosynthesis, and organophosphorus compounds (Worthington and Walker, 1983). The activity of these compounds is typically limited to several species or genera of fungi. As a consequence of the large number and diversity of pathogenic fungi, these compounds have not provided an effective solution to limiting fungal infections in plants.

An alternative approach to controlling fungal infections in plants involves identifying and developing biological compounds with antifungal activity. Identification of such compounds involves screening various organisms, such as plants and microbes, for agents possessing antifungal activity. Extracts are prepared from the organisms and tested in an in vitro antifungal assay. The antifungal agents can then be isolated from the extracts and further characterized. Several classes of antifungal proteins have been identified in this manner including chitinases, defensins, cysteine-rich chitin-binding proteins, β-1,3-glucanases, permatins (including zeamatins), thionins, ribosome-inactivating proteins, and non-specific lipid transfer proteins (Bowles, 1990; Brears et al., 1994, Broekaert et al., 1997).

A number of publications have described methods of using antifungal proteins from plants and bacteria in transgenic plants. The antifungal proteins used in these methods include glucanases, chitinases, osmotin-like proteins, and lysozymes produced in transgenic plants exhibiting increased resistance to various microorganisms (EP 0 292 435, EP 0 290 123, WO 88/00976, U.S. Pat. No. 4,940,840, WO 90/07001, EP 0 392 225, EP 0 307 841, EP 0 332 104, EP 0 440 304, EP 0 418 695, EP 0 448 511, WO 91/06312, WO 93/05153, and WO 91/18984).

Recombinant DNA technology has led to the development of transgenic plants that can produce antimicrobial proteins. The process generally involves transforming a plant tissue with a nucleic acid sequence encoding an antifungal protein, inducing the formation of transgenic tissue, and regenerating a plant from the transgenic tissue. Techniques for transformation of dicots are reviewed in Gasser and Fraley (1989). Monocot transformation and plant regeneration are reviewed in Davey et al. (1986) and Davey et al. (1989).

The antifungal activity of some of these proteins is dramatically reduced in the presence of 1 mM $CaCl_2$ and 50 mM KCl (Terras et al., 1992). Metal ions, such $K^+$, $Na^+$, $Ca^{2+}$, and $Mg^{2+}$, are required for normal physiological functions of plants and are abundant in plant cells. For an antifungal protein to be useful, it must maintain its antifungal activity in the presence of these ions. As a result, many of the proteins demonstrating antifungal activity in vitro are not efficacious in vivo.

Thus, there exists a need in the art for new classes of antifungal proteins, particularly those that exhibit antifungal activity against a large variety of pathogens and maintain that activity under the in vivo conditions of a plant.

SUMMARY OF THE INVENTION

The invention relates to antifungal proteins, and methods for their use. Specifically, the invention encompasses antifungal proteins, nucleic acid sequences encoding the antifungal proteins, transformed host cells and transgenic plants expressing the antifungal proteins and useful for producing the antifungal proteins, and compositions containing the antifungal proteins. Methods are also disclosed for preparing the transformed host cells and transgenic plants.

A novel antifungal protein, isolated from *Fusarium culmorum*, is disclosed. This protein, termed FCWP1, displays significant antifungal activity against a variety of fungal species. By altering a proteolytic consensus sequence contained within FCWP1, new variants are produced with improved stability of the antifungal activity.

A novel class of antifungal proteins related to FCWP1 is also disclosed. The proteins in this class are ribosomal proteins and have similar values for pI and molecular weight. A representative number of proteins from this class were tested and found to possess significant antifungal activities.

The antifungal proteins disclosed herein are useful in controlling fungal infections in plants. Transgenic plants may be produced that are more resistant to fungal infections relative to non-transgenic plants of the same species. Alternatively, the proteins may be applied to plants exogenously.

DESCRIPTION OF THE FIGURES

The following figures form part of the present specification and are included to further demonstrate certain aspects of the present invention. The invention may be better understood by reference to one or more of these drawings in combination with the detailed description of specific embodiments presented herein.

The elements contained in the Figures illustrating plasmids are defined as follows: AMP: β-Lactamase; ori-pUC: replication origin derived from pUC plasmid; LAC: partial sequence of the Lac Z coding sequence; p-e35S: promoter e35S; HSP70 intron: the intron of heat shock protein 70 from maize; NOS3': 3' untranslated region of the nopaline synthase (nos) coding sequence of Agrobacterium Ti plasmid; ori-M13: M13 phage replication origin; Spc/Str: aminoglycoside adenyl transferase; p-FMV: figwort mosaic virus 35S promoter; EPSPS/CTP2: chloroplast transit peptide from the Arabidopsis 5-enolpyruvyl-3-phosphoshikimate synthase coding sequence (EPSPS); CP4 syn: synthetic bacterial glyphosate resistance coding sequence (CP4/5-enolpyruvyl-3-phosphoshikimate synthase); E9 3': 3' untranslated region of the pea ssRUBISCO E9 coding sequence; PetHSP70-Leader: 5' untranslated leader sequence of petunia heat shock protein 70 coding sequence; ori-322: pUC322 replication origin; ori V: the vegetative origin of replication; rop: coding region for the repressor of primer; Left Border: octopine left border; Right Border: sequence essential for transfer T-DNA; AlyAFP: antifungal protein from alyssum flower; alysigsynFCWP1: signal peptide from AlyAFP fused to the synthetic coding sequence of Fusarium culmorum antifungal protein (FCWP1).

FIG. 3 shows the FCWP1 cDNA (SEQ ID NO:18) translation (SEQ ID NO:1754).
FIG. 4 is a sequence alignment of the cDNA translation of FCWP1 (SEQ ID NO:1754) and the yeast ribosomal protein RPG19 (SEQ ID NO:1564).

DESCRIPTION OF SEQUENCES

Figure 1:
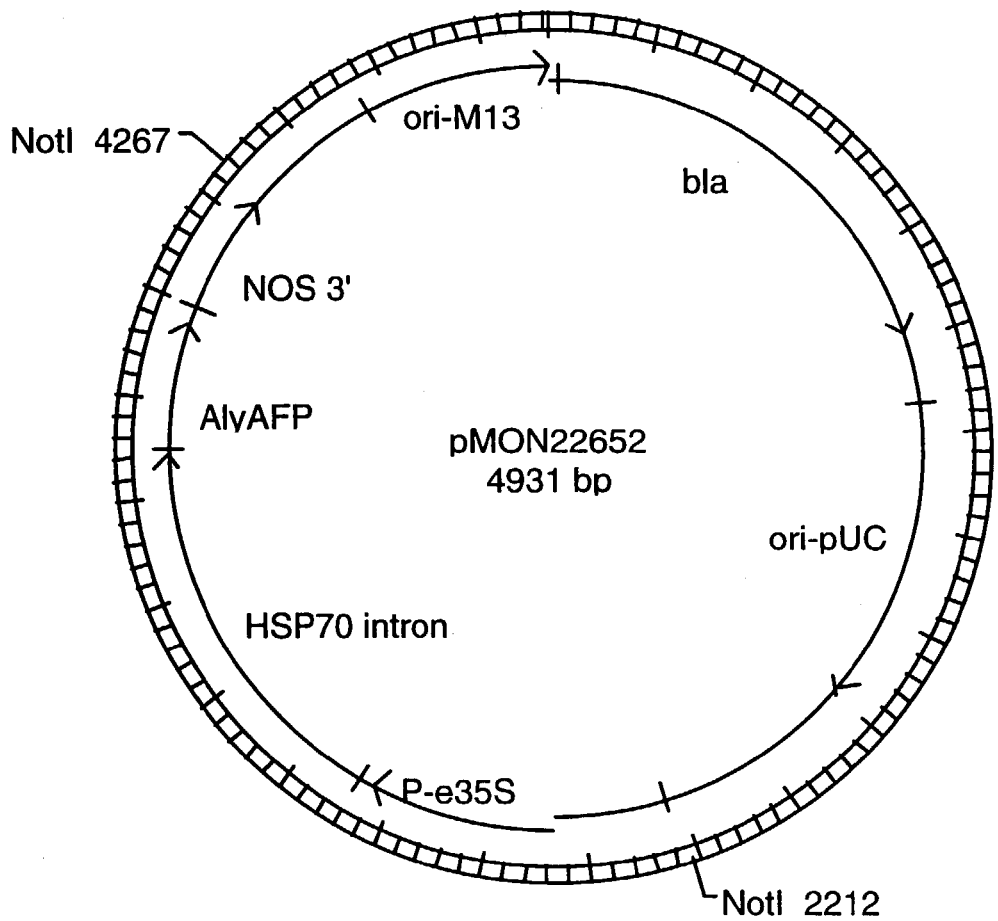
FIG. 1 is a plasmid map of pMON22652.

The following sequence listings form part of the present specification and are included to further demonstrate certain aspects of the present invention. The invention may be better understood by reference to one or more of these sequences in combination with the detailed description of specific embodiments presented herein.

| SEQ ID NO: | Description |
| --- | --- |
| 1 | FCWP 1 amino acid sequence |
| 2 | fcwp1 nucleic acid coding sequence |
| 3 | fcwp1.5, 75-mer (Example 6) |
| 4 | fcwp1.6, 77-mer (Example 6) |
| 5 | fcwp1.7, 29-mer (Example 6) |
| 6 | fcwp1.8, 29-mer (Example 6) |
| 7 | AlyAFP, 38-mer (Examples 7, 20) |

-continued

| SEQ ID NO: | Description |
| --- | --- |
| 8 | AlyAFP, 41-mer (Example 7) |
| 9 | fcwp1.9, 20-mer (Example 7, 11) |
| 10 | fcwp1.10, 30-mer (Example 7, 11) |
| 11 | AlyAFP signal/fcwp1 fusion |
| 12 | fcwp1.4, 34-mer (Example 10) |
| 13 | PolyG-RI, 30-mer (Example 10) |
| 14 | 5' fcwp1 cDNA sequence |
| 15 | CAR 61, 37-mer (Example 11) |
| 16 | Poly-T, 32-mer (Example 11) |
| 17 | 3' fcwp1 cDNA sequence |
| 18 | fcwp1 full length cDNA sequence |
| 19 | FCWP2 amino acid sequence |
| 20 | FCWP3 amino acid sequence |
| 21 | FCWP4 amino acid sequence |
| 22 | FCWP5 amino acid sequence |
| 23 | FCWP6 amino acid sequence |
| 24 | FCWP7 amino acid sequence |
| 25 | FCWP2 Oligomer (Example 20) |
| 26 | FCWP3 Oligomer (Example 20 |
| 27 | FCWP4 Oligomer (Example 20) |
| 28 | FCWP5 Oligomer (Example 20) |
| 29 | FCWP6 Oligomer (Example 20) |
| 30 | FCWP7 Oligomer (Example 20) |
| 31 | BL-32, B. rapa chloroplast ribosomal protein |
| 32 | BL-36, Black pine chloroplast ribosomal protein |
| 33 | SL-23, Spinach chloroplast ribosomal protein |
| 34 | YL-46, Yeast ribosomal protein |
| 35 | YL-41, Yeast ribosomal protein |
| 36 | BL-36 synthetic DNA sequence for wheat |
| 37 | BL-36 synthetic DNA sequence for potato |
| 38-1753 | ribosomal protein sequences; calculated pI > 7 and MW <20 kDa |

DEFINITIONS

The following definitions are provided in order to aid those skilled in the art in understanding the detailed description of the present invention.

"Antifungal" refers to an activity that kills, inhibits, or disrupts fungal growth. This activity may target sporulation, mating, or spore germination. The antifungal activity may also interfere with the normal development of fungal cells by disrupting or retarding any stage of the fungal lifecycle.

"Antigenic epitope" refers to any discrete segment of a molecule, protein, or nucleic acid capable of eliciting an immune response, wherein the immune response results in the production of antibodies reactive with the antigenic epitope.

"Coding sequence" and "open reading frame" refer to a region of continuous sequential nucleic acid triplets encoding a protein, polypeptide, or peptide sequence.

"Hybridization" refers to the ability of a strand of nucleic acid to join with a complementary strand via base pairing. Hybridization occurs when complementary sequences in the two nucleic acid strands bind to one another.

"Identical" nucleotide or protein sequences are determined by using programs such as GAP or BestFit from GCG (Genetics Computer Group, Inc., Madison, Wis.) using the default parameters.

"Nucleic acid" refers to deoxyribonucleic acid (DNA) and ribonucleic acid (RNA).

"Phenotype" refers to traits exhibited by an organism resulting from the interaction of genotype and environment.

"pI" refers to the pH value at which a protein or peptide has no net overall charge. At pH values below the pI, the protein or peptide will be positively charged, and at pH values above the pI, the protein or peptide will be negatively charged.

"Polyadenylation signal" or "polyA signal" refers to a nucleic acid sequence located 3' to a coding region that promotes the addition of adenylate nucleotides to the 3' end of the mRNA transcribed from the coding region.

"Promoter" or "promoter region" refers to a nucleic acid sequence, usually found upstream (5') to a coding sequence, that controls expression of the coding sequence by controlling production of messenger RNA (mRNA) by providing the recognition site for RNA polymerase or other factors necessary for start of transcription at the correct site.

"Recombinant nucleic acid vector" refers to any agent such as a plasmid, cosmid, virus, autonomously replicating sequence, phage, or linear or circular single-stranded or double-stranded DNA or RNA nucleotide segment, derived from any source, capable of genomic integration or autonomous replication, comprising a nucleic acid molecule in which one or more nucleic acid sequences have been linked in a functionally operative manner. Such recombinant nucleic acid constructs or vectors are capable of introducing a 5' regulatory sequence or promoter region and a DNA sequence for a selected gene product into a cell in such a manner that the DNA sequence is transcribed into a functional mRNA, which is subsequently translated into a polypeptide or protein. Recombinant nucleic acid constructs or recombinant vectors may be constructed to be capable of expressing antisense RNAs, in order to inhibit translation of a specific RNA of interest.

"Regeneration" refers to the process of growing a plant from a plant cell (e.g., plant protoplast or explant).

"Ribosomal protein" refers to a protein, polypeptide, or peptide found in association with a ribosome in vivo.

"Selectable marker" refers to a nucleic acid sequence whose expression confers a phenotype facilitating identification of cells containing the nucleic acid sequence. Selectable markers include those that confer resistance to toxic chemicals (e.g., ampicillin resistance, kanamycin resistance), complement a nutritional deficiency (e.g., uracil, histidine, leucine), or impart a visually distinguishing characteristic (e.g., color changes or fluorescence).

"Transcription" refers to the process of producing an RNA copy from a DNA template.

"Transformation" refers to a process of introducing an exogenous nucleic acid sequence (e.g., a vector, recombinant nucleic acid molecule) into a cell or protoplast in which that exogenous nucleic acid is incorporated into a chromosome or is capable of autonomous replication.

"Transgenic" refers to organisms into which exogenous nucleic acid sequences are integrated.

"Vector" refers to a plasmid, cosmid, bacteriophage, or virus that carries exogenous DNA into a host organism.

DETAILED DESCRIPTION OF THE INVENTION

The invention relates to antifungal proteins and methods for their use. Specifically, the invention encompasses antifungal proteins, nucleic acid sequences encoding the antifungal proteins, transformed host cells and transgenic plants expressing the antifungal proteins and useful for producing the antifungal proteins, and compositions containing the antifungal proteins. Methods are also disclosed for preparing the transformed host cells and transgenic plants.

Protein Sequences

The invention is directed to a protein that preferably is at least about 85% identical to SEQ ID NO:1, more preferably is at least about 86%, 87%, 88%, 89%, 90%, 91%, 92%, 93%, 94%, 95%, 96%, 97%, 98%, or 99% identical to SEQ ID NO:1, and most preferably is SEQ ID NO:1.

To further aid in the study and application of the protein of SEQ ID NO:1, antibodies may be prepared. These antibodies may be raised against any portion of the protein that provides an antigenic epitope. The antibodies may be polyclonal or monoclonal. Such an antibody is preferably immunoreactive with SEQ ID NO:1.

The protein that is at least about 85% to 100% identical to SEQ ID NO:1 is preferably reactive with such antibodies.

The antibodies may be used to detect the presence of SEQ ID NO:1 by ELISA, radioimmunoassay, immunoblot, western blot, immunofluorescence, immuno-precipitation, or any other comparable technique. In addition, a kit may be designed that incorporates one or more of these techniques that use the antibodies described above to detect SEQ ID NO:1.

Nucleic Acid Sequences

The invention is also directed to a nucleic acid segment comprising a nucleic acid sequence encoding a protein at least about 85% identical to SEQ ID NO:1, more preferably encoding a protein at least about 86%, 87%, 88%, 89%, 90%, 91%, 92%, 93%, 94%, 95%, 96%, 97%, 98%, or 99% identical to SEQ ID NO:1, and most preferably encoding SEQ ID NO:1.

Alternatively, the nucleic acid sequence is preferably at least about 85% identical to SEQ ID NO:2, more preferably is at least about 86%, 87%, 88%, 89%, 90%, 91%, 92%, 93%, 94%, 95%, 96%, 97%, 98%, or 99% identical to SEQ ID NO:2, and most preferably is SEQ ID NO:2.

Alternatively, the nucleic acid sequence is preferably at least about 85% identical to SEQ ID NO:18, more preferably is at least about 86%, 87%, 88%, 89%, 90%, 91%, 92%, 93%, 94%, 95%, 96%, 97%, 98%, or 99% identical to SEQ ID NO:18, and most preferably is SEQ ID NO:18.

The structural nucleic acid sequences may be obtained (i.e., cloned or isolated) from various species of plants, animals, bacteria, and fungi and utilized in the present invention. Preferably, the structural nucleic acid sequence is derived from a plant, fungal, or bacterial source or is chemically synthesized.

Nucleic Acid Hybridization

The nucleic acid sequence may be further identified by its ability to hybridize with a complementary sequence. Nucleic acid hybridization is a technique well known to those of skill in the art of DNA manipulation. The hybridization properties of a given pair of nucleic acids are an indication of their similarity or identity.

Low stringency conditions may be used to select sequences with lower sequence identities to a target sequence. One may wish to employ conditions such as about 0.15 M to about 0.9 M sodium chloride, at temperatures ranging from about 20° C. to about 55° C.

High stringency conditions may be used to select for nucleic acid sequences with higher degrees of identity to the disclosed sequences (Sambrook et al., 1989). The high stringency conditions typically involve nucleic acid hybridization in about 2× to about 10×SSC (diluted from a 20×SSC stock solution containing 3 M sodium chloride and 0.3 M sodium citrate, pH 7.0 in distilled water), about 2.5× to about 5×Denhardt's solution (diluted from a 50× stock solution containing 1% (w/v) bovine serum albumin, 1% (w/v) ficoll, and 1% (w/v) polyvinylpyrrolidone in distilled water), about 10 mg/mL to about 100 mg/mL fish sperm DNA, and about 0.02% (w/v) to about 0.1% (w/v) SDS, with an incubation at about 50° C. to about 70° C. for several hours to overnight. The high stringency conditions are preferably provided by 6×SSC, 5×Denhardt's solution, 100 mg/mL fish sperm DNA, and 0.1% (w/v) SDS, with an incubation at 55° C. for several hours.

The hybridization is generally followed by several wash steps. The wash compositions generally comprise 0.5× to about 10×SSC, and 0.01% (w/v) to about 0.5% (w/v) SDS with a 15-minute incubation at about 20° C. to about 70° C. Preferably, the nucleic acid segments remain hybridized after washing at least one time in 0.1×SSC at 65° C.

The nucleic acid sequence preferably hybridizes, under low or high stringency conditions, with SEQ ID NO:2, or the complement thereof. Alternatively, the nucleic acid sequence preferably hybridizes, under low or high stringency conditions, with SEQ ID NO:18, or the complement thereof.

Related Antifungal Proteins

Additional proteins, similar to SEQ ID NO:1 with respect to molecular weight and pI, were identified and characterized. These were found to also have antifungal activity. These antifungal proteins generally have a small molecular weight and a high pI and are ribosomal proteins. The pI preferably is greater than about 7, more preferably is greater than about 10, and most preferably is greater than about 11.5. The molecular weight preferably is between about 2 kDa and about 20 kDa, more preferably is between about 2 kDa and about 15 kDa, and most preferably is between about 3 kDa and about 7 kDa.

Nucleic Acid Sequences Encoding the Related Antifungal Proteins

Nucleic acid segments comprising nucleic acid sequences encoding the aforementioned antifungal proteins may be obtained. Such nucleic acid sequences preferably encode an antifungal ribosomal protein having a pI that is greater than about 7, more preferably is greater than about 10, and most preferably is greater than about 11.5. The nucleic acid also may encode an antifungal protein with a molecular weight that is preferably between about 2 kDa and about 20 kDa, more preferably is between about 2 kDa and about 15 kDa, and most preferably is between about 3 kDa and about 7 kDa.

The nucleic acid sequence may encode an antifungal protein at least about 85% identical to SEQ ID NOS: 19, 20, 21, 22, 23, 24, 31, 32, 33, 34, or 35, more preferably encode an antifungal protein at least about 86%, 87%, 88%, 89%, 90%, 91%, 92%, 93%, 94%, 95%, 96%, 97%, 98%, or 99% identical to SEQ ID NOS: 19, 20, 21, 22, 23, 24, 31, 32, 33, 34, or 35, and most preferably encode SEQ ID NOS: 19, 20, 21, 22, 23, 24, 31, 32, 33, 34, or 35.

The structural nucleic acid sequences may be obtained (i.e., cloned or isolated) from various species of plants, animals, bacteria, and fungi and utilized in the present invention. Preferably, the structural nucleic acid sequence is derived from a plant, fungal, or bacterial source or is chemically synthesized.

The above mentioned nucleic acid sequences may be provided in a variety of forms. For instance, the nucleic acid sequence may be contained within a segment of cDNA, genomic DNA, synthetic DNA, or plasmid DNA. Alternatively, the nucleic acid sequence may be contained in an RNA molecule. Each of these forms of nucleic acid will preferably encode an antifungal protein as disclosed in the present invention. These different forms may be utilized to produce recombinant vectors, transformed host cells, and transgenic plants.

Fusion Proteins

Fusion proteins may be constructed that comprise an antifungal protein and a fusion partner comprising at least one additional amino acid, peptide, or protein. Many possible fusion partners exist. For instance, the fusion partner may provide a "tagged" epitope to facilitate detection of the protein. Alternatively, the fusion partner may provide a regulatory, enzymatic, or intercellular transport function. SEQ ID NO:11 demonstrates a fusion product of the SEQ ID NO:2 with a nucleic acid encoding a signal peptide of an antifungal protein isolated from *Alyssum* (AlyAFP1) (U.S. Pat. No. 5,773,696).

The pI of the antifungal ribosomal protein contained within the fusion protein preferably is greater than about 7, more preferably is greater than about 10, and most preferably is greater than about 11.5. The molecular weight of the antifungal protein preferably is between about 2 kDa and about 20 kDa, more preferably is between about 2 kDa and about 15 kDa, and most preferably is between about 3 kDa and about 7 kDa.

Alternatively, the antifungal protein within the fusion protein is at least about 85% identical to SEQ ID NO:1, more preferably is at least about 86%, 87%, 88%, 89%, 90%, 91%, 92%, 93%, 94%, 95%, 96%, 97%, 98%, or 99% identical to SEQ ID NO:1, and most preferably is SEQ ID NO:1.

The fusion protein comprising an amino acid sequence at least between about 85% and about 100% identical with SEQ ID NO:1 is preferably reactive with an antibody raised against an antigenic epitope from SEQ ID NO:1.

The antifungal protein may also preferably be at least about 85% identical to SEQ ID NOS: 19, 20, 21, 22, 23, 24, 31, 32, 33, 34, or 35, more preferably at least about 86%, 87%, 88%, 89%, 90%, 91%, 92%, 93%, 94%, 95%, 96%, 97%, 98%, or 99% identical to SEQ ID NOS: 19, 20, 21, 22, 23, 24, 31, 32, 33, 34, or 35, and most preferably is SEQ ID NOS: 19, 20, 21, 22, 23, 24, 31, 32, 33, 34, or 35.

Codon Usage

Due to the degeneracy of the genetic code, different nucleotide codons may be used to code for a particular amino acid. A host cell often displays a preferred pattern of codon usage (Campbell et al., 1990). Nucleic acid sequences are preferably constructed to utilize the codon usage pattern of the particular host cell. This generally enhances the expression of the nucleic acid sequence in a transformed host cell. The nucleic acid sequences disclosed herein preferably utilize the optimal codon usage for bacterial, fungal, and plant host cells.

Modifications of Nucleic Acid Sequences Encoding Antifungal Proteins

Variations in the nucleic acid sequence encoding an antifungal protein may lead to mutant antifungal protein sequences that display equivalent or superior antifungal characteristics when compared to the sequences disclosed herein. Mutations may include deletions, insertions, truncations, substitutions, fusions, shuffling of subunit sequences, and the like.

Mutations to a nucleic acid sequence may be introduced in either a specific or random manner, both of which are well known to those of skill in the art of molecular biology. A myriad of site-directed mutagenesis techniques exist, typically using oligonucleotides to introduce mutations at specific locations in a nucleic acid sequence. Examples include single strand rescue (Kunkel, 1985), unique site elimination (Deng and Nickloff, 1992), nick protection (Vandeyar et al., 1988), and PCR (Costa et al., 1996). Random or non-specific mutations may be generated by chemical agents (for a general review, see Singer and Kusmierek, 1982) such as nitrosoguanidine (Cerda-Olmedo et al., 1968; Guerola et al., 1971) and 2-aminopurine (Rogan and Bessman, 1970), or by biological methods such as passage through mutator strains (Greener et al., 1997).

The modifications may result in either conservative or non-conservative changes in the amino acid sequence. Conservative changes result from additions, deletions, substitutions, etc. in the nucleic acid sequence that do not alter the final amino acid sequence of the protein. Non-conservative changes include additions, deletions, and substitutions that result in an altered amino acid sequence.

Additional methods of making the alterations described above are described by Ausubel et al. (1995); Bauer et al. (1985); Craik (1985); Frits Eckstein et al. (1982); Sambrook et al. (1989); Smith et al. (1981); Osuna et al. (1994); and Walder et al. (1986).

Modification and changes may be made in the sequence of the proteins of the present invention and the nucleic acid segments that encode them and still obtain a functional molecule that encodes a protein with desirable antifungal properties. The following is a discussion based upon changing the amino acid sequence of a protein to create an equivalent, or possibly an improved, second-generation molecule. The amino acid changes may be achieved by changing the codons of the nucleic acid sequence, according to the codons given in Table 1.

TABLE 1

Codon degeneracies of amino acids

| Amino acid | One letter | Three letter | Codons |
|---|---|---|---|
| Alanine | A | Ala | GCA GCC GCG GCT |
| Cysteine | C | Cys | TGC TGT |
| Aspartic acid | D | Asp | GAC GAT |
| Glutamic acid | E | Glu | GAA GAG |
| Phenylalanine | F | Phe | TTC TTT |
| Glycine | G | Gly | GGA GGC GGG GGT |
| Histidine | H | His | CAC CAT |
| Isoleucine | I | Ile | ATA ATG ATT |
| Lysine | K | Lys | AAA AAG |
| Leucine | L | Leu | TTA TTG CTA CTG CTG CTT |
| Methionine | M | Met | ATG |
| Asparagine | N | Asn | AAC AAT |
| Proline | P | Pro | CCA CCC CCG CCT |
| Glutamine | Q | Gln | GAA GAG |
| Arginine | R | Arg | AGA AGG CGA CGG GGG CGT |
| Serine | S | Ser | AGC AGT TCA TGC TCG TCT |
| Threonine | T | Thr | ACA ACC ACG ACT |
| Valine | V | Val | GTA GTG GTG GTT |
| Tryptophan | W | Trp | TGG |
| Tyrosine | Y | Tyr | TAC TAT |

Certain amino acids may be substituted for other amino acids in a protein sequence without appreciable loss of enzymatic activity. It is thus contemplated that various changes may be made in the peptide sequences of the disclosed protein sequences, or their corresponding nucleic acid sequences, without appreciable loss of the biological activity.

In making such changes, the hydropathic index of amino acids may be considered. The importance of the hydropathic amino acid index in conferring interactive biological function on a protein is generally understood in the art (Kyte and Doolittle, 1982). It is accepted that the relative hydropathic character of the amino acid contributes to the secondary structure of the resultant protein, which in turn defines the interaction of the protein with other molecules, for example, enzymes, substrates, receptors, DNA, antibodies, antigens, and the like.

Each amino acid has been assigned a hydropathic index on the basis of its hydrophobicity and charge characteristics. These are isoleucine (+4.5); valine (+4.2); leucine (+3.8); phenylalanine (+2.8); cysteine/cystine (+2.5); methionine (+1.9); alanine (+1.8); glycine (−0.4); threonine (−0.7); serine (−0.8); tryptophan (−0.9); tyrosine (−1.3); proline (−1.6); histidine (−3.2); glutamate/glutamine/aspartate/asparagine (−3.5); lysine (−3.9); and arginine (−4.5).

It is known in the art that certain amino acids may be substituted by other amino acids having a similar hydropathic index or score and still result in a protein with similar biological activity, i.e., still obtain a biologically functional protein. In making such changes, the substitution of amino acids whose hydropathic indices are within ±2 is preferred, those within ±1 are more preferred, and those within ±0.5 are most preferred.

It is also understood in the art that the substitution of like amino acids may be made effectively on the basis of hydrophilicity. U.S. Pat. No. 4,554,101 states that the greatest local average hydrophilicity of a protein, as governed by the hydrophilicity of its adjacent amino acids, correlates with a biological property of the protein. The following hydrophilicity values have been assigned to amino acids: arginine/lysine (+3.0); aspartate/glutamate (+3.0±1); serine (+0.3); asparagine/glutamine (+0.2); glycine (0); threonine (−0.4); proline (−0.5±1); alanine/histidine (−0.5); cysteine (−1.0); methionine (−1.3); valine (−1.5); leucine/isoleucine (−1.8); tyrosine (−2.3); phenylalanine (−2.5); and tryptophan (−3.4).

It is understood that an amino acid may be substituted by another amino acid having a similar hydrophilicity score and still result in a protein with similar biological activity, i.e., still obtain a biologically functional protein. In making such changes, the substitution of amino acids whose hydropathic indices are within ±2 is preferred, those within ±1 are more preferred, and those within ±0.5 are most preferred.

As outlined above, amino acid substitutions are therefore based on the relative similarity of the amino acid side-chain substituents, for example, their hydrophobicity, hydrophilicity, charge, size, and the like. Exemplary substitutions that take various of the foregoing characteristics into consideration are well known to those of skill in the art and include: arginine and lysine; glutamate and aspartate; serine and threonine; glutamine and asparagine; and valine, leucine, and isoleucine. Changes that are not expected to be advantageous may also be used if these resulted in functional antifungal proteins.

Sequence Analysis

In the present invention, sequence similarity or identity can be determined using the "BestFit" or "Gap" programs of the Sequence Analysis Software Package, Genetics Computer Group, Inc., University of Wisconsin Biotechnology Center, Madison, Wis. 53711. The programs were used with the default parameters.

Proteins falling in the class of antifungal proteins described were identified by searching in the public sequence databases using the search string "ribosom." The software used for searching was the LookUp program supplied with GCG version 9.1 (Genetics Computer Group, Inc., Madison, Wis.). The set of sequences returned was edited by a biologist to eliminate sequences that were not ribosomal proteins. The edited set was then searched using IsoSearch, a computer program written at Monsanto that calculates the mass and predicted pI of proteins, for proteins with a pI>7 and a molecular mass <20 kDa. (Monsanto Company, St. Louis, Mo.)

The predicted isoelectric point (pI) of each protein was calculated using the HasIsoPoint algorithm in GCG version 9.1 (supplied as Fortran code but rewritten in C). This algorithm, written originally by L. L. Houston and rewritten by Frank J. Manion of the Fox Chase Cancer Center, Philadelphia, Pa., uses a binary search that assumes the net charge of a protein is a monotonic decreasing function over the pH range from pH 1.0 to pH 13.0.

pK data was obtained from the isoelectric.dat table supplied with GCG version 9.1, based upon Bull (An Introduction to Physical Biochemistry, 1964).

Protein mass was calculated using the average atomic masses of unhydrated amino acids derived from the aafreq-.dat table supplied with GCG version 9.1.

Recombinant Vectors

Any of the above mentioned structural nucleic acid sequences may be used to prepare a recombinant vector. The recombinant vector typically comprises, in a 5' to 3' orientation: a promoter to direct the transcription of a structural nucleic acid sequence, a structural nucleic acid sequence, a 3' transcriptional terminator, and a 3' polyadenylation signal. The recombinant vector may further comprise untranslated sequences, transit and targeting sequences, selectable markers, enhancers, or operators.

Means for preparing recombinant vectors are well known in the art. Methods for making recombinant vectors particularly suited to plant transformation are described in U.S. Pat. Nos. 4,971,908, 4,940,835, 4,769,061 and 4,757,011. These types of vectors have also been reviewed (Rodriguez et al., 1988; Glick et al., 1993).

Typical vectors useful for expression of nucleic acids in higher plants are well known in the art and include vectors derived from the tumor-inducing (Ti) plasmid of *Agrobacterium tumefaciens* (Rogers et al., 1987). Other recombinant vectors useful for plant transformation, including the pCaM-VCN transfer control vector, have also been described (Fromm et al., 1985).

Promoters

The selection of a suitable promoter depends on the type of host cell in which it will be used. Promoters that function in bacteria, yeast, and plants are all well taught in the art.

The promoter may also be selected on the basis of transcriptional regulation that it provides. Such regulation may include enhancement of transcriptional activity, inducibility, tissue specificity, and developmental stage specificity. In plants, promoters that are inducible, of viral or synthetic origin, constitutively active, and temporally regulated and spatially regulated have been described (Poszkowski et al., 1989; Odell et al., 1985; Chau et al., 1989).

Often-used constitutive promoters include the CaMV 35S promoter (Odell, 1985), the enhanced CaMV 35S promoter, the Figwort Mosaic Virus (FMV) promoter (Richins et al., 1987), the mannopine synthase (mas) promoter, the nopaline synthase (nos) promoter, and the octopine synthase (ocs) promoter.

Useful inducible promoters include promoters induced by salicylic acid or polyacrylic acids (PR-1, Williams, 1992), induced by application of safeners (substituted benzenesulfonamide herbicides, Hershey, 1991), heat-shock promoters (Ou-Lee et al., 1986; Ainley et al., 1990), a nitrate-inducible promoter derived from the spinach nitrite reductase sequence (Back et al., 1991), hormone-inducible promoters (Yamaguchi-Shinozaki et al., 1990; Kares et al., 1990), and light-inducible promoters associated with the small subunit of RuBP carboxylase and LHCP families (Kuhlemeier et al., 1989; Feinbaum et al., 1991; Weisshaar et al., 1991; Lam and Chua, 1990; Castresana et al., 1988; Schulze-Lefert et al., 1989).

Examples of useful tissue-specific, developmentally regulated promoters include the β-conglycinin 7S promoter (Doyle et al., 1986; Slighton and Beachy, 1987) and seed-specific promoters (Knutzon et al., 1992; Bustos et al., 1991; Lam and Chua, 1991; Stayton et al., 1991). Plant functional promoters useful for preferential expression in seed plastids include those from plant storage proteins and from proteins involved in fatty acid biosynthesis in oilseeds. Examples of such promoters include the 5' regulatory regions from such sequences as napin (Kridl et al., 1991), phaseolin, zein, soybean trypsin inhibitor, ACP, stearoyl-ACP desaturase, and oleosin. Seed-specific regulation is discussed in EP 0 255 378.

Another exemplary tissue-specific promoter is the lectin promoter, which is specific for seed tissue. The lectin protein in soybean seeds is encoded by a single nucleic acid sequence (Le1) that is only expressed during seed maturation and accounts for about 2% to about 5% of total seed mRNA. The lectin nucleic acid sequence and seed-specific promoter have been fully characterized and used to direct seed-specific expression in transgenic tobacco plants (Vodkin et al., 1983; Lindstrom et al., 1990.)

A suitable promoter may also be induced during a plant defense response against a fungal infection. Typically, a fungal infection triggers an induction of a large number of pathogenesis-related (PR) proteins by the infected plant (Bowles, 1990; Bol et al., 1990; Linthorst, 1991). Such PR proteins may be enzymes involved in phenylpropanoid metabolism (e.g., phenylalanine ammonia lyase, chalcone synthase), proteins that modify plant cell walls (e.g., hydroxyproline-rich glycoproteins, glycine-rich proteins, peroxidases), enzymes that degrade fungal cell walls (e.g., chitinases, glucanases), thaumatin-like proteins, or proteins with as yet unknown functions.

The promoters of these PR sequences may be obtained and utilized in the present invention. Isolation of these PR promoters has been reported from potato plants (Fritzemeier et al., 1987; Cuypers et al., 1988; Logemann et al., 1989; Matton et al., 1989; Schroder et al., 1992) and tobacco plants (Martini et al., 1993).

Promoter hybrids can also be constructed to enhance transcriptional activity (Comai, L. and Moran, P. M., U.S. Pat. No. 5,106,739, issued Apr. 21, 1992), or to combine desired transcriptional activity and tissue specificity.

Promoters having particular utility in the present invention include the nopaline synthase (nos), mannopine synthase (mas), and octopine synthase (ocs) promoters, which are carried on tumor-inducing plasmids of *Agrobacterium tumefaciens*; the cauliflower mosaic virus (CaMV) 19S and 35S promoters; the enhanced CaMV 35S promoter; the Figwort Mosaic Virus (FMV) 35S promoter; the light-inducible promoter from the small subunit of ribulose-1,5-bisphosphate carboxylase (ssRUBISCO); the EIF-4A promoter from tobacco (Mandel et al., 1995); corn sucrose synthetase 1 (Yang and Russell, 1990); corn alcohol dehydrogenase 1 (Vogel et al., 1989); corn light harvesting complex (Simpson, 1986); corn heat shock protein (Odell et al., 1985); the chitinase promoter from *Arabidopsis* (Samac et al., 1991); the LTP (Lipid Transfer Protein) promoters from broccoli (Pyee et al., 1995); petunia chalcone isomerase (Van Tunen et al., 1988); bean glycine rich protein 1 (Keller et al., 1989); potato patatin (Wenzler et al., 1989); the ubiquitin promoter from maize (Christensen et al., 1992); the sugarcane badnavirus promoter; the rice RC2 promoter; and the actin promoter from rice (McElroy et al., 1990). All of these promoters have been used to create various types of DNA constructs that have been expressed in plants. See, for example, PCT International Publication WO 84/02913 in this regard.

Structural Nucleic Acid Sequences

The structural nucleic acid sequence preferably encodes an antifungal ribosomal protein having a pI that is greater than about 7, more preferably is greater than about 10, and most preferably is greater than about 11.5. The nucleic acid also may encode an antifungal protein with a molecular weight that is preferably between about 2 kDa and about 20 kDa, more preferably is between about 2 kDa and about 15 kDa, and most preferably is between about 3 kDa and about 7 kDa.

The structural nucleic acid sequence may encode a protein at least about 85% identical to SEQ ID NO:1, more preferably encodes a protein at least about 86%, 87%, 88%, 89%, 90%, 91%, 92%, 93%, 94%, 95%, 96%, 97%, 98%, or 99% identical to SEQ ID NO:1, and most preferably encodes SEQ ID NO:1.

Alternatively, the nucleic acid sequence is preferably at least about 85% identical to SEQ ID NO:2, more preferably is at least about 86%, 87%, 88%, 89%, 90%, 91%, 92%, 93%, 94%, 95%, 96%, 97%, 98%, or 99% identical to SEQ ID NO:2, and most preferably is SEQ ID NO:2.

Alternatively, the nucleic acid sequence is preferably at least about 85% identical to SEQ ID NO:18, more preferably is at least about 86%, 87%, 88%, 89%, 90%, 91%, 92%, 93%, 94%, 95%, 96%, 97%, 98%, or 99% identical to SEQ ID NO:18, and most preferably is SEQ ID NO:18.

The structural nucleic acid sequence may be further identified by its ability to hybridize with a complementary sequence. Various conditions for nucleic acid hybridizations are well taught in the art (Sambrook et al., 1989; Ausubel et al., 1995). The structural nucleic acid sequence preferably hybridizes, under low or high stringency conditions, with SEQ ID NO:2, or the complement thereof. Alternatively, the structural nucleic acid sequence preferably hybridizes, under low or high stringency conditions, with SEQ ID NO:18, or the complement thereof.

Alternatively, the structural nucleic acid sequence may encode an antifungal protein at least about 85% identical to SEQ ID NOS: 19, 20, 21, 22, 23, 24, 31, 32, 33, 34, or 35, more preferably encode an antifungal protein at least about 86%, 87%, 88%, 89%, 90%, 91%, 92%, 93%, 94%, 95%, 96%, 97%, 98%, or 99% identical to SEQ ID NOS: 19, 20, 21, 22, 23, 24, 31, 32, 33, 34, or 35, and most preferably encode SEQ ID NOS: 19, 20, 21, 22, 23, 24, 31, 32, 33, 34, or 35.

The structural nucleic acid sequences may be obtained (i.e., cloned or isolated) from various species of plants, animals, bacteria, and fungi and utilized in the present invention. Preferably, the structural nucleic acid sequence is derived from a plant, fungal, or bacterial source or is chemically synthesized.

Other Elements of the Recombinant Vector

A 3' non-translated region typically provides a transcriptional termination signal and a polyadenylation signal that functions in plants to cause the addition of adenylate nucleotides to the 3' end of the mRNA. These may be obtained from the 3' regions to the nopaline synthase (nos) coding sequence, the soybean 7S storage protein coding sequence, and the pea ssRUBISCO E9 coding sequence, or from the Agrobacterium tumor-inducing (Ti) plasmid (Fischhoff et al., European Patent Application 0 385 962; U.S. Pat. No. 5,500,365).

The recombinant vector may further comprise a selectable marker. The nucleic acid sequence serving as the selectable marker functions to produce a phenotype in cells that facilitates their identification relative to cells not containing the marker. Useful selectable markers include GUS, green fluorescent protein (GFP), neomycin phosphotransferase II (nptII), luciferase (LUX), antibiotic resistance sequences, and herbicide (e.g., glyphosphate) tolerance sequences. The selectable marker is preferably a kanamycin, hygromycin, or herbicide resistance marker.

Typically, nucleic acid sequences located a few hundred base pairs downstream of the polyadenylation site serve to terminate transcription. These regions are required for efficient polyadenylation of transcribed mRNA.

The recombinant vector may further comprise a nucleic acid sequence encoding a transit peptide, such as the Alyssum signal peptide or the chloroplast transit peptide from Arabidopsis. This peptide may be useful for directing a protein to the extracellular space or to some other compartment inside or outside of the cell.

Translational enhancers may also be incorporated as part of the recombinant vector. Thus the recombinant vector may preferably contain one or more 5' non-translated leader sequences that serve to enhance expression of the nucleic acid sequence. Such enhancer sequences may be desirable to increase or alter the translational efficiency of the resultant mRNA.

Probes and Primers

Short nucleic acid sequences having the ability to specifically hybridize to complementary nucleic acid sequences may be produced and utilized in the present invention. These short nucleic acid molecules may be used as probes to identify the presence of a complementary sequence in a given sample. Thus, by constructing a nucleic acid probe that is complementary to a small portion of a particular nucleic acid sequence, the presence of that sequence may be assessed. Use of these probes may greatly facilitate the identification of transgenic plants that contain a particular nucleic acid sequence (e.g., a nucleic acid sequence encoding an antifungal protein). The probes may also be used to screen cDNA or genomic libraries for additional sequences encoding antifungal proteins.

Alternatively, the short nucleic acid sequences may be used as oligonucleotide primers to amplify or mutate a complementary nucleic acid sequence using PCR technology. These primers may also facilitate the amplification of related complementary sequences (e.g., related nucleic acid sequences from other species).

The primer or probe is generally complementary to a portion of the nucleic acid sequence that is to be identified, amplified, or mutated. The primer or probe should be of sufficient length to form a stable and sequence-specific duplex molecule with its complement. The primer or probe preferably is about 10 to about 200 nucleotides long, more preferably is about 10 to about 100 nucleotides long, even more preferably is about 10 to about 50 nucleotides long, and most preferably is about 14 to about 30 nucleotides long.

The primer or probe may be prepared by direct chemical synthesis, by PCR (U.S. Pat. Nos. 4,683,195, and 4,683, 202), or by excising the nucleic acid specific fragment from a larger nucleic acid molecule.

Transgenic Plants and Transformed Host Cells

The invention is also directed to transgenic plants and transformed host cells that comprise, in a 5' to 3' orientation: a promoter to direct the transcription of a structural nucleic acid sequence, a structural nucleic acid sequence, a 3' transcriptional terminator, and a 3' polyadenylation signal.

The structural nucleic acid sequence preferably encodes a ribosomal protein having a pI that is greater than about 7, more preferably is greater than about 10, and most preferably is greater than about 11.5. The structural nucleic acid encodes a protein with a molecular weight that is preferably between about 2 kDa and about 20 kDa, more preferably is between about 2 kDa and about 15 kDa, and most preferably is between about 3 kDa and about 7 kDa.

The promoter may be seed selective, tissue selective, constitutive, or inducible. Such promoters include the nopaline synthase (NOS), octopine synthase (OCS), mannopine synthase (mas), cauliflower mosaic virus 19S and 35S (CaMV19S, CaMV35S), enhanced CaMV (eCaMV), ribulose 1,5-bisphosphate carboxylase (ssRUBISCO), figwort mosaic virus (FMV), CaMV derived AS4, tobacco RB7 wheat POX1 promoter, tobacco EIF-4, lectin protein (Le1), and rice RC2 promoter.

The structural nucleic acid sequence encodes a protein at least about 85% identical to SEQ ID NO:1, more preferably encodes a protein at least about 86%, 87%, 88%, 89%, 90%, 91%, 92%, 93%, 94%, 95%, 96%, 97%, 98%, or 99% identical to SEQ ID NO:1, and most preferably encodes SEQ ID NO:1.

Alternatively, the structural nucleic acid sequence is preferably at least about 85% identical to SEQ ID NO:2, more preferably is at least about 86%, 87%, 88%, 89%, 90%, 91%, 92%, 93%, 94%, 95%, 96%, 97%, 98%, or 99% identical to SEQ ID NO:2, and most preferably is SEQ ID NO:2.

Alternatively, the structural nucleic acid sequence is preferably at least about 85% identical to SEQ ID NO:18, more preferably is at least about 86%, 87%, 88%, 89%, 90%, 91%, 92%, 93%, 94%, 95%, 96%, 97%, 98%, or 99% identical to SEQ ID NO:18, and most preferably is SEQ ID NO:18.

The structural nucleic acid sequence may be further identified by its ability to hybridize with a complementary sequence. Various conditions for nucleic acid hybridizations are well taught in the art (Sambrook et al., 1989; Ausubel et al., 1995). The structural nucleic acid sequence preferably hybridizes, under low or high stringency conditions, with SEQ ID NO:2, or the complement thereof. Alternatively, the structural nucleic acid sequence preferably hybridizes, under low or high stringency conditions, with SEQ ID NO:18, or the complement thereof.

Alternatively, the structural nucleic acid sequence may encode a protein at least about 85% identical to SEQ ID NOS: 19, 20, 21, 22, 23, 24, 31, 32, 33, 34, or 35, more preferably encode a protein at least about 86%, 87%, 88%, 89%, 90%, 91%, 92%, 93%, 94%, 95%, 96%, 97%, 98%, or 99% identical to SEQ ID NOS: 19, 20, 21, 22, 23, 24, 31, 32, 33, 34, or 35, and most preferably encode SEQ ID NO: 19, 20, 21, 22, 23, 24, 31, 32, 33, 34, or 35.

The transformed host cell may generally be any cell that is compatible with the present invention. The transformed host cell may be prokaryotic, such as a bacterial cell, and more preferably is a *Agrobacterium, Arthrobacter, Azospyrillum, Clavibacter, Escherichia, Pseudomonas,* or *Rhizobacterium* cell. The transformed host cell preferably is eukaryotic, and more preferably is a plant, yeast, or fungal cell. If a yeast cell is selected to be transformed, it preferably is a *Saccharomyces cerevisiae, Schizosaccharomyces pombe,* or *Pichia pastoris.* If a plant cell is selected to be transformed, it may be of any type capable of being transformed, preferably one with an agronomic, horticultural, ornamental, economic, or commercial value and more preferably is an *Acacia*, alfalfa, aneth, apple, apricot, artichoke, arugula, asparagus, avocado, banana, barley, beans, beet, blackberry, blueberry, broccoli, brussels sprouts, cabbage, canola, cantaloupe, carrot, cassava, castorbean, cauliflower, celery, cherry, chicory, cilantro, citrus, clementines, clover, coconut, coffee, corn, cotton, cucumber, Douglas fir, eggplant, endive, escarole, eucalyptus, fennel, figs, garlic, gourd, grape, grapefruit, honey dew, jicama, kiwifruit, lettuce, leeks, lemon, lime, Loblolly pine, linseed, mango, melon, mushroom, nectarine, nut, oat, oil palm, oil seed rape, okra, olive, onion, orange, an ornamental plant, palm, papaya, parsley, parsnip, pea, peach, peanut, pear, pepper, persimmon, pine, pineapple, plantain, plum, pomegranate, poplar, potato, pumpkin, quince, radiata pine, radicchio, radish, rapeseed, raspberry, rice, rye, sorghum, Southern pine, soybean, spinach, squash, strawberry, sugarbeet, sugarcane, sunflower, sweet potato, sweetgum, tangerine, tea, tobacco, tomato, triticale, turf, turnip, a vine, watermelon, wheat, yams, or zucchini cell.

A transgenic plant is then preferably regenerated from the transformed cell using routine techniques available to one skilled in the art. The resulting transgenic plant is preferably more resistant to fungal infection relative to a non-transgenic plant of the same species.

Compositions Containing Antifungal Proteins

The antifungal proteins of the present invention may also be provided in a composition suitable for application to plants. General methods of preparing the compositions have been described (Martens, 1979; Winnacker-Kuchler, 1986). The composition generally comprises an antifungal ribosomal protein with a small molecular weight and a high pI. The pI of such a protein preferably is greater than about 7, more preferably is greater than about 10, and most preferably is greater than about 11.5. The molecular weight preferably is between about 2 kDa and about 20 kDa, more preferably is between about 2 kDa and about 15 kDa, and most preferably is between about 3 kDa and about 7 kDa.

The antifungal protein preferably is at least about 85% identical to SEQ ID NO:1, more preferably is at least about 86%, 87%, 88%, 89%, 90%, 91%, 92%, 93%, 94%, 95%, 96%, 97%, 98%, or 99% identical to SEQ ID NO:1, and most preferably is SEQ ID NO:1.

The antifungal protein in the composition, comprising an amino acid sequence at least between about 85% and about 100% identical with SEQ ID NO:1, is preferably reactive with an antibody raised against an antigenic epitope from SEQ ID NO:1.

The antifungal protein may also preferably be at least about 85% identical to SEQ ID NOS: 19, 20, 21, 22, 23, 24, 31, 32, 33, 34, or 35, more preferably at least about 86%, 87%, 88%, 89%, 90%, 91%, 92%, 93%, 94%, 95%, 96%, 97%, 98%, or 99% identical to SEQ ID NOS: 19, 20, 21, 22, 23, 24, 31, 32, 33, 34, or 35, and most preferably SEQ ID NOS: 19, 20, 21, 22, 23, 24, 31, 32, 33, 34, or 35.

The antifungal protein may also be used in combination with other antifungal agents, so as to provide a broader spectrum of activity. Examples of such other antifungal agents include *Bacillus thuringiensis* endotoxin, chitinases, cysteine-rich chitin-binding proteins, β-1,3-glucanases, permatins (including zeamatins), defensins, thionins, ribosome-inactivating proteins, and non-specific lipid transfer proteins. The antifungal protein may also be used in combination with various chemical antifungal agents including polyoxines, nikkomycines, carboxyamides, aromatic carbohydrates, carboxines, morpholines, inhibitors of sterol biosynthesis, and organophosphorus compounds (Worthington and Walker, 1983).

The composition may also contain other types of antimicrobial agents including antibiotics, insecticides, acaricides, nematicides, herbicides, or other such compounds. The composition may further comprise carrier molecules, surfactants, fertilizers, growth regulators, solvents, inert materials, attractants, sterilizing agents, or equivalent types of additives. The use of many of these additives in compositions has been described (Watkins, 1955; Winnacker-Kuchler, 1986).

Alternatively, the antifungal protein may be expressed by transformed host cells that colonize a host plant. For instance, a bacteria or yeast cell may be transformed with a nucleic acid encoding an antifungal protein (as described above) and allowed to colonize on a host plant. As a colony of these transformed host cells is established, the cells in the colony typically produce the antifungal protein. This affords the host plant a degree of protection against fungal infections.

The antifungal protein, whether provided in a transgenic plant, a transformed host cell, or a composition, may have antifungal activity against a broad range of genera and species including: *Alternaria* (*Alternaria brassicola; Alternaria solani*); *Ascochyta* (*Ascochyta pisi*); *Botrytis* (*Botrytis cinerea*); *Cercospora* (*Cercospora kikuchii; Cercospora zaea-maydis*); *Colletotrichum* (*Colletotrichum lindemuthianum*); *Diplodia* (*Diplodia maydis*); *Erysiphe* (*Erysiphe graminis* f. sp. *graminis; Erysiphe graminis* f. sp. *hordei*); *Fusarium* (*Fusarium nivale; Fusarium oxysporum; Fusarium graminearum; Fusarium culmorum; Fusarium solani; Fusarium moniliforme; Fusarium roseum*); *Gaeumanomyces* (*Gaeumanomyces graminis* f. sp. *tritici*); *Helminthosporium* (*Helminthosporium turcicum; Helminthosporium carbonum; Helminthosporium maydis*); *Macrophomina* (*Macrophomina phaseolina; Maganaporthe grisea*); *Mycosphaerella* (*Mycosphaerella figiensis*); *Nectria* (*Nectria heamatococca*); *Peronospora* (*Peronospora manshurica; Peronospora tabacina*); *Phoma* (*Phoma betae*); *Phymatotrichum* (*Phymatotrichum omnivorum*); *Phytophthora* (*Phytophthora cinnamomi; Phytophthora cactorum; Phytophthora phaseoli; Phytophthora parasitica; Phytophthora citrophthora; Phytophthora megasperma* f. sp. *sojae; Phytophthora infestans*); *Plasmopara* (*Plasmopara viticola*); *Podosphaera* (*Podosphaera leucotricha*); *Puccinia* (*Puccinia sorghi; Puccinia striiformis; Puccinia graminis* f. sp. *tritici; Puccinia asparagi; Puccinia recondita; Puccinia arachidis*); *Puthium* (*Puthium aphanidermatum*); *Pyrenophora* (*Pyrenophora tritici-repentens*); *Pyricularia* (*Pyricularia oryzae*); *Pythium* (*Pythium ultimum*); *Rhizoctonia* (*Rhizoctonia solani; Rhizoctonia cerealis*); *Scerotium* (*Scerotium rolfsii*); *Sclerotinia* (*Sclerotinia sclerotiorum*); *Septoria*(*Septoria lycopersici; Septoria glycines; Stagonospora nodorum/Phaeosphaeria nodorum; Septoria tritici*); *Thielaviopsis* (*Thielaviopsis basicola*); *Uncinula* (*Uncinula necator*); *Venturia* (*Venturia inaequalis*); or *Verticillium* (*Verticillium dahliae; Verticillium albo-atrum*). Most preferably, the antifungal proteins of the present invention display activity against *Botrysis, Cercospora, Erysiphe, Fusarium, Phytophthora, Puccinia, Rhizoctonia, Sclerotinia, Septoria*, or *Verticillium*.

Method for Preparing Transformed Host Cells Containing an Antifungal Protein

The invention is further directed to a method for preparing a transformed host cell comprising, in a 5' to 3' orientation: a promoter to direct the transcription of a structural nucleic acid sequence, a structural nucleic acid sequence, a 3' transcriptional terminator, and a 3' polyadenylation signal.

The method generally comprises the steps of selecting a suitable host cell, transforming the host cell with a recombinant vector, and obtaining the transformed host cell. There are many methods for introducing nucleic acids into host cells. Suitable methods include bacterial infection (e.g., *Agrobacterium*), binary bacterial artificial chromosome vectors, direct delivery of DNA (e.g., via PEG-mediated transformation, desiccation/inhibition-mediated DNA uptake, electroporation, agitation with silicon carbide fibers, and acceleration of DNA coated particles, etcetera (reviewed in Potrykus et al., 1991).

Technology for introduction of DNA into cells is well known to those of skill in the art. These methods can generally be classified into four categories: (1) chemical methods (Graham and van der Eb, 1973; Zatloukal et al., 1992); (2) physical methods such as microinjection (Capecchi, 1980), electroporation (Wong and Neumann, 1982; Fromm et al., 1985; U.S. Pat. No. 5,384,253), and particle acceleration (Johnston and Tang, 1994; Fynan et al., 1993); (3) viral vectors (Clapp, 1993; Lu et al., 1993; Eglitis and Anderson, 1988); and (4) receptor-mediated mechanisms (Curiel et al., 1992; Wagner et al., 1992).

Alternatively, nucleic acids can be introduced into pollen by directly injecting a plant's reproductive organs (Zhou et al., 1983; Hess, 1987; Luo et al., 1988; Pena et al., 1987). The nucleic acids may also be injected into immature embryos (Neuhaus et al., 1987).

The recombinant vector used to transform the host cell typically comprises, in a 5' to 3' orientation: a promoter to direct the transcription of a structural nucleic acid sequence, a structural nucleic acid sequence, a 3' transcriptional terminator, and a 3' polyadenylation signal. The recombinant vector will preferably comprise a promoter selected for its desired expression characteristics, the nucleic acid sequence of the present invention as previously described, and a suitable 3' terminator and polyadenylation signal. The recombinant vector may further comprise untranslated sequences, transit and targeting sequences, selectable markers, enhancers, or operators.

Method for Preparing Transgenic Plants Containing an Antifungal Protein

The invention is further directed to a method for preparing transgenic plants more resistant to fungal infections than non-transgenic plants of the same species, comprising selecting a suitable plant cell, transforming the plant cell with a recombinant vector, obtaining the transformed host cell, and regenerating a transgenic plant.

The recombinant vector typically comprises, in a 5' to 3' orientation: a promoter to direct the transcription of a structural nucleic acid sequence, a structural nucleic acid sequence, a 3' transcriptional terminator, and a 3' polyadenylation signal. The recombinant vector may further comprise untranslated sequences, transit and targeting sequences, selectable markers, enhancers, or operators.

The regeneration, development, and cultivation of plants from transformed plant protoplast or explants is well taught in the art (Weissbach and Weissbach, 1988; Horsch et al., 1985). In this method, transformants are generally cultured in the presence of a medium that selects for the successfully transformed cells and induces the regeneration of plant shoots (Fraley et al., 1983). These shoots are typically obtained within two to four months.

The shoots are then transferred to an appropriate root-inducing medium containing the selective agent and an antibiotic to prevent bacterial growth. Many of the shoots will develop roots. These are then transplanted to soil or other media to allow the continued development of roots. The method, as outlined, will generally vary depending on the particular plant strain employed.

Preferably, the regenerated transgenic plants are self-pollinated to provide homozygous transgenic plants. Alternatively, pollen obtained from the regenerated transgenic plants may be crossed with non-transgenic plants, preferably inbred lines of agronomically important species. Conversely, pollen from non-transgenic plants may be used to pollinate the regenerated transgenic plants.

The transgenic plant may pass along the nucleic acid sequence encoding the antifungal protein to its progeny. The transgenic plant is preferably homozygous for the nucleic acid encoding the antifungal protein and transmits that sequence to all of its offspring as a result of sexual reproduction. Progeny may be grown from seeds produced by the transgenic plant. These additional plants may then be self-pollinated to generate a true breeding line of plants.

The progeny from these plants are evaluated, among other things, for gene expression and disease resistance (e.g., antifungal properties). The gene expression may be detected by several common methods such as western blotting, northern blotting, immunoprecipitation, and ELISA. Disease resistance is generally tested in the field under a range of environmental conditions.

The transgenic plant may generally be any type of plant, preferably is one with agronomic, horticultural, ornamental, economic, or commercial value, and more preferably is an *Acacia*, alfalfa, aneth, apple, apricot, artichoke, arugula, asparagus, avocado, banana, barley, beans, beet, blackberry, blueberry, broccoli, brussels sprouts, cabbage, canola, cantaloupe, carrot, cassava, castorbean, cauliflower, celery, cherry, chicory, cilantro, citrus, clementines, clover, coconut, coffee, corn, cotton, cucumber, Douglas fir, eggplant, endive, escarole, eucalyptus, fennel, figs, garlic, gourd, grape, grapefruit, honey dew, jicama, kiwifruit, lettuce, leeks, lemon, lime, Loblolly pine, linseed, mango, melon, mushroom, nectarine, nut, oat, oil palm, oil seed rape, okra, olive, onion, orange, an ornamental plant, palm, papaya, parsley, parsnip, pea, peach, peanut, pear, pepper, persimmon, pine, pineapple, plantain, plum, pomegranate, poplar, potato, pumpkin, quince, radiata pine, radicchio, radish, rapeseed, raspberry, rice, rye, sorghum, Southern pine, soybean, spinach, squash, strawberry, sugarbeet, sugarcane, sunflower, sweet potato, sweetgum, tangerine, tea, tobacco, tomato, triticale, turf, turnip, a vine, watermelon, wheat, yams, or zucchini plant.

EXAMPLES

The following examples are included to demonstrate preferred embodiments of the invention. It should be appreciated by those of skill in the art that the techniques disclosed in the examples that follow represent techniques discovered by the inventors to function well in the practice of the invention, and thus can be considered to constitute preferred modes for its practice. However, those of skill in the art should, in light of the present disclosure, appreciate that many changes can be made in the specific embodiments that are disclosed and still obtain a like or similar result without departing from the spirit and scope of the invention.

Example 1

Isolation of an Antifungal Protein

*Fusarium culmorum* from a stock culture was used to inoculate petri plates containing solid synthetic medium. The solid synthetic medium (Terras et al., 1993) contained $K_2HPO_4$ (2.5 mM), $MgSO_4$ (50 μM), $CaCl_2$ (50 μM), $FeSO_4$ (5 μM), $CoCl_2$ (0.1 μM), $CuSO_4$ (0.1 μM), $Na_2MoO_4$ (2 μM), $H_3BO_3$ (0.5 μM), KI (0.1 μM), $ZnSO_4$ (0.5 μM), $MnSO_4$ (0.1 μM), glucose (10 μL), asparagine (1 g/L), methionine (20 mg/L), myo-inositol (2 mg/L), biotin (0.2 mg/L), thiamine-HCl (1 mg/L), pyridoxine-HCl (0.2 mg/L), and Bacto-agar (Difco, Detroit, Mich., 15 g/L). The plates were incubated at 22° C. for about 1 week. Sporulation was then induced by cutting the fungus into cross sectional pieces in the petri plate using a spatula. After several days, the plates were scraped and the spores harvested.

Flasks containing liquid synthetic media (same media as above without the agar) were inoculated with the harvested spores. After overnight incubation at 22° C. with gentle stirring, new fungal spores were produced and collected by filtration. These spores were washed with 20 mM sodium acetate (pH 5.2), and then washed with 20 mM sodium acetate (pH 3.2) containing 1 M NaCl to release proteins off fungal cells. The high salt wash was then precipitated with ammonium sulfate at 80% saturation. The precipitate was collected, redissolved in 20 mL distilled $H_2O$, and dialyzed against distilled water (3 changes of water over 24 hours). The dialyzed spore solution was dried to completion in a Savant SPEEDVAC AES 2000 (SPEEDVAC is a registered trademark of Savant Instruments, Inc., Holbrook, N.Y.) and redissolved in 200 μL distilled water.

The spore solution was then passed through a SUPEROSE-12 FPLC gel filtration column (SUPEROSE is a registered trademark of Pharmacia Inc., Piscataway, N.J.). Spore proteins were eluted in phosphate buffered saline at a flow rate of 0.4 mL/minute. Fractions containing proteins were detected by UV absorbance at 280 nm.

Fractions were tested for antifungal activity against *Fusarium culmorum* (as described in Example 4). The fractions that exhibited fungicidal activity were collected and loaded onto a MONO Q anion exchange column (MONO Q is a registered trademark of Pharmacia Inc., Piscataway, N.J.). The column was then washed several times with 50 mM Tris, pH 9.0 (solution A). Proteins were eluted from the column by gradually increasing the amount of solution B (50 mM Tris, pH 9.0, and 1 M NaCl) passing through the column, relative to solution A. A linear gradient was used in which solution B increased from 0% to 40% at a rate of 1% each minute.

Fractions containing proteins eluted from the MONO Q column were independently collected and loaded onto an analytical C18 reverse phase chromatography column (VYDAC, Hesperia, Calif.). The column was washed several times using solvent A (0.1% trifluoroacetic acid in water). Proteins were eluted in a linear gradient in which solvent B (0.1% trifluoroacetic acid in acetonitrile) was increased at a rate of 1% B each minute while the flow rate was 1 mL/minute. Proteins were detected by UV light absorbance at a wavelength of 214 nm.

Each fraction collected was again tested for antifungal activity (as described in Example 4) Fractions exhibiting antifungal activity were dried to completion in the SPEED-VAC and redissolved in 50 µL distilled water.

Example 2

Characterization of the Antifungal Protein

Gel electrophoresis was employed to detect proteins contained in the fractions exhibiting antifungal activity (Laemmli, 1970). Briefly, a sample from the fraction was dissolved in denaturing sample buffer (450 mM Tris-HCl, pH 8.45, 12% (v/v) glycerol, 4% (w/v) SDS, 0.06% (w/v) Coomassie Blue G, and 0.0025% (w/v) Phenol Red) and boiled for 10 minutes. The sample was then loaded onto a 16% tricine gel and electrophoresed in electrophoresis buffer (100 mM Tris, 100 mM tricine, and 1% SDS) at 125V for two hours. The buffers and gel were obtained from Novex Co., San Diego, Calif.

Silver staining (Integrated Separation Systems, Natick, Mass.) revealed a protein of approximately 95% purity with a molecular weight of approximately 5 kDa.

Example 3

Sequencing the Purified Antifungal Protein

In order to determine the amino acid sequence of the protein in the antifungal fraction, the purified protein from Example 1 was denatured in 8 M urea containing 8 mM dithiothreitol. These denaturing reagents were then removed by dialysis against distilled water using a membrane having a molecular weight cut off of 1,000 (Spectra/PorO, Spectrum, Houston, Tex.).

Automated Edman degradation was carried out on an Applied Biosystems Model 470A Protein Sequenator (Applied Biosystems, Norwalk, Conn.), using conditions recommended by the manufacturer. The PTH-amino acid derivatives were identified by reversed phase analysis in an on-line fashion employing an Applied Biosystems Model 120 PTH Analyzer.

N-terminal sequencing of the protein resolved a full-length amino acid sequence of SEQ ID NO:1. The sequence consists of 40 amino acids, 40% of which are basic. Sequence database searches in GenBank revealed that the sequence had not previously been identified. This novel protein was assigned the name FCWP1.

Example 4

Testing the Antifungal Activity of FCWP1

The fungicidal activity of FCWP1 was determined against several fungal species in an in vitro antifungal assay. The assay was performed in sterile 96-well flat-bottom microtiter plates.

*Fusarium culmorum* spores were obtained as described in Example 1 and resuspended in double strength testing media ($K_2HPO_4$ (5 mM), $MgSO_4$ (100 µM), $CaCl_2$ (100 µM), $FeSO_4$ (10 µM), $CoCl_2$ (0.2 µM), $CuSO_4$ (0.2 µM), $Na_2MoO_4$ (4 µM), $H_3BO_3$ (1.0 µM), KI (0.2 µM), $ZnSO_4$ (1.0 µM), $MnSO_4$ (1.0 µM), glucose (20 g/L), asparagine (2 g/L), methionine (40 mg/L), myo-inositol (4 mg/L), biotin (0.4 mg/L), thiamine-HCl (2 mg/L), pyridoxine-HCl (0.4 mg/L)) at a concentration of $2 \times 10^4$ spores/mL. Approximately 1000 spores were added (50 µl) to each test well. These spores were allowed to germinate for 5 to 15 hours at 22° C.

*Phytophthora infestans* spores were obtained from LB-V-8 agar plates (5.5 oz. of V-8 juice, 23 grams of Lima Bean agar (Difco, Detroit, Mich.), and 2.3 grams of $CaCO_3$) that were inoculated with a 5 mm section of fungal mycelium from a stock culture. These plates were incubated for about ten days at 18° C. Sporulation was induced by macerating the fungal growth with a sterile glass rod. Approximately five days later, the sporangia were collected by washing the surface of the assay plate with 15% V-8 liquid medium (5.5 oz. of V-8 juice mixed with solid $NaHCO_3$ until the pH is approximately 6.0), centrifuged at 15,000×g for 30 minutes, filter-sterilized using a 0.22 micron filter, and diluted to 15% with sterile distilled water. About 1000 sporangia were added per well in a total volume of 50 µL. These spores were allowed to germinate for 5 to 15 hours at 18° C.

After spore germination, 50 µL of sterile solution containing the test protein in distilled water were added to each of the test wells. The FCWP1 protein was tested in a concentration range from 0 to 80 µg/mL to determine $IC_{50}$ values. Protein concentrations were determined using the BCA protein assay kit obtained from Pierce Co. (Rockford, Ill.).

The assay was performed under low and high salt conditions. To test wells designated for high salt conditions, $CaCl_2$ and KCl were added to final concentrations of 1 mM and 50 mM, respectively. This salt-supplemented medium is referred to as "high salt medium." The low salt conditions were provided by the media in which the spores were resuspended without additional supplements. This medium is referred to as "low salt medium."

The spores were incubated with the test proteins under the low or high salt conditions for 15 to 24 hours at 24° C.

Table 2 shows the antifungal activity of FCWP1 against *Fusarium culmorum*, the causal agent of wheat head scab, and *Phytophthora infestans*, the causal agent of late blight in potato and tomato. The antifungal activity is expressed as the concentration in µg/mL required to cause 50% inhibition of fungal hyphal growth ($IC_{50}$). The percentage of fungal hyphal growth inhibition is defined as $$\frac{\text{average hyphae length in a test culture}}{\text{average hyphae length in a control culture}} \times 100$$

The test culture was treated with a solution of water containing the antifungal protein. The control culture was treated with water only.

TABLE 2

Antifungal Activity of Purified FCWP1

| Fungus | $IC_{50}$ (µg/mL) | |
|---|---|---|
| | Low salt | High salt |
| F. culmorum | 5 | >50 |
| P. infestans | 5 | 20 |

The data in Table 2 demonstrate that FCWP1 exhibits potent antifungal activity against *Fusarium* and *Phytophthora*, which cause disease on many crop plants. The concentration in µg/mL required to cause 50% inhibition of fungal hyphal growth ($IC_{50}$) can be realistically achieved in plants transformed with a nucleic acid sequence encoding the FCWP1 protein.

Example 5

Production of a Synthetic FCWP1 Protein

A synthetic protein identical to that of SEQ ID NO:1 was produced by Bio•Synthesis Inc. (Lewisville, Tex.). The purity of the synthetic FCWP1 was determined by mass spectral analysis to be >95%. The molecular weight of the synthetic FCWP1 was 4,504 Daltons, as determined by mass spectral analysis.

This synthetic FCWP1 protein was tested in an in vitro fungal assay against *F. culmorum*, *P. infestans*, and *S. nodorum*. The assay was performed as described in Example 4. These results (Table 3) demonstrate that the antifungal activity of the synthetic FCWP1 protein is essentially the same as that of the native FCWP1 purified from *F. culmorum* (Table 2).

TABLE 3

Antifungal Activity of a Synthetic FCWP1 Protein

| Fungi | $IC_{50}$ (µg/mL) | |
|---|---|---|
| | Low salt | High salt |
| *F. culmorum* | 6 | 85 |
| *S. nodorum* | 22 | >170 |
| *P. infestans* | 10 | 20 |

Example 6

Production of a Nucleic Acid Sequence Encoding the FCWP Protein

The FCWP1 antifungal protein consists of 40 amino acids. Using the amino acid sequence of SEQ ID NO:1, a nucleic acid molecule encoding FCWP1 was constructed by PCR. All of the reactions described (3' extension of the annealed PCR products and the PCR amplification of the full length sequence) were conducted in a single tube, in a single PCR reaction using the Long Range Template PCR kit (Boehringer Mannheim Corp., Indianapolis, Ind.) following the conditions suggested by the manufacturer. The kit included all the necessary enzymes and buffers. Oligonucleotide primers were produced by Midland Certified Reagent Co., (Midland, Tex.).

Regulatory elements, such as an initiating methionine (ATG) codon and a stop codon, were added to the nucleic acid sequence. Due to the degeneracy of the genetic code, several codons are possible for any particular amino acid. Each type of cell or organism, however, has a preferred pattern of codon usage. The codon usage was selected such that it was optimal for several different systems including *E. coli*, yeast, and potato. Optimal codon usage was determined as described by Campbell et al. (1990).

The full length synthetic fcwp1 was produced using PCR in a two-step reaction. First, a double-stranded nucleic acid molecule was produced that contained the coding sequence of fcwp1. An oligonucleotide primer (SEQ ID NO:3) consisting of the first 75 nucleotides of the fcwp1 sense strand was annealed to a second oligonucleotide primer (SEQ ID NO:4) consisting of 77 nucleotides of the fcwp1 antisense strand. These two oligonucleotides are complementary to each other over a region of 25 base pairs. A double-stranded DNA molecule encoding the full length FCWP1 protein was obtained by PCR reaction followed by 3'-extension of the annealed products.

In a second reaction, this double-stranded fcwp1 DNA was amplified. This was accomplished by using two primers (SEQ ID NOS:5 and 6) that anneal to the 3' end of the fcwp1 sense and antisense strands, respectively. The amplifying primers contained restriction sites for BamHI and NcoI (SEQ ID NO:5), and EcoRI (SEQ ID NO:6). These provide convenient sites for subcloning the final PCR product.

The final PCR product was separated on a 2% agarose gel, and a nucleic acid band of about 140 base pairs was visualized after ethidium bromide staining. This nucleic acid band was purified from the gel and ligated into plasmid pNoTA/T7 (Invitrogen, San Diego, Calif.).

The sequence of the synthetic gene was confirmed using a 373 DNA Sequencer Stretch Model from Applied Biosystem using the PRISM Ready Reaction Dideoxy Terminator Cycle Sequencing Kit following the manufacturer's instructions (Applied Biosystems, Inc., Foster City, Calif.).

Example 7

Construction of Recombinant Vectors for Transformation

The fcwp1 synthetic nucleic acid sequence (SEQ ID NO:2) was fused in a PCR reaction to a second nucleic acid sequence (SEQ ID NO:8) encoding a signal peptide from the AlyAFP protein. The signal sequence is described in U.S. Pat. No. 5,773,696. Immunohistochemical studies indicated that this signal peptide functions to target the protein to the extracellular space of plant tissue.

In all PCR reactions described, the Long Range Template PCR kit (Boehringer Mannheim, Indianapolis, Ind.) was used, following the conditions suggested by the manufacturer. Oligonucleotide primers were produced by Midland Certified Reagent Co. (Midland, Tex.).

In the first PCR reaction, a fusion between the AlyAFP signal sequence and fcwp1 was constructed. The two primers used for amplification were (1) a 38-mer (SEQ ID NO:7) with 14 nucleotides that provided restriction sites and 24 nucleotides complementary to the 5' terminus of the AlyAFP signal sequence; and (2) a 41-mer (SEQ ID NO:8) with 10 nucleotides corresponding to the C-terminus of the AlyAFP signal sequence and 31 nucleotides complementary to the 5' end of fcwp1 (including an ATG start site). Plasmid pMON22652 (FIG. 1) was used as a template for the PCR reaction. The PCR product was separated on an agarose gel and observed as a 130 base pair fragment after staining with ethidium bromide. The fragment was excised from the agarose gel and purified using an ULTRAFREE-MC centrifugation filtration unit (ULTRAFREE is a registered trademark of Millipore Inc., Bedford, Mass.).

A second PCR reaction used the plasmid containing the fcwp1 synthetic nucleic acid sequence of SEQ ID NO:2 as a template for producing a full-length fcwp1 template. The two primers used for amplification were (1) a 20-mer (SEQ ID NO:9) containing the 5' portion of the fcwp1 synthetic gene; and (2) a 30-mer (SEQ ID NO:10) containing 21 nucleotides complementary to the 3' terminus of the fcwp1 nucleic acid sequence along with 9 nucleotides for a BamHI cloning site. The PCR product, a 150 base pair fragment, was purified from a gel as described previously.

A third PCR reaction generated the final full-length AlyAFP signal sequence/fcwp1 fusion product of approximately 250 base pairs (SEQ ID NO:11). This nucleic acid molecule was gel purified and used for subsequent cloning steps.

The BamHI restriction sites located on the 5' and 3' ends of the fusion product were utilized to clone the final AlyAFP signal sequence/fcwp1 fusion product into a previously constructed FMV expression cassette vector, pMON1770.

Figure 2:
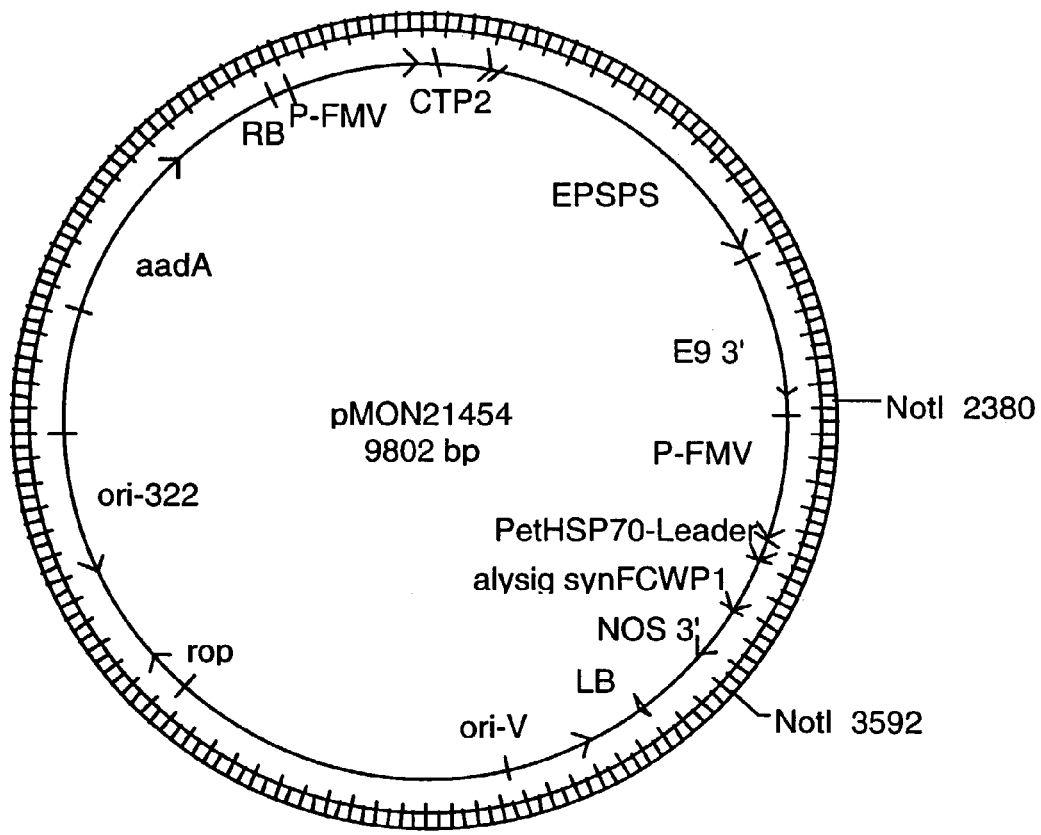
FIG. 2 is a plasmid map of pMON21454.
Figure 5:
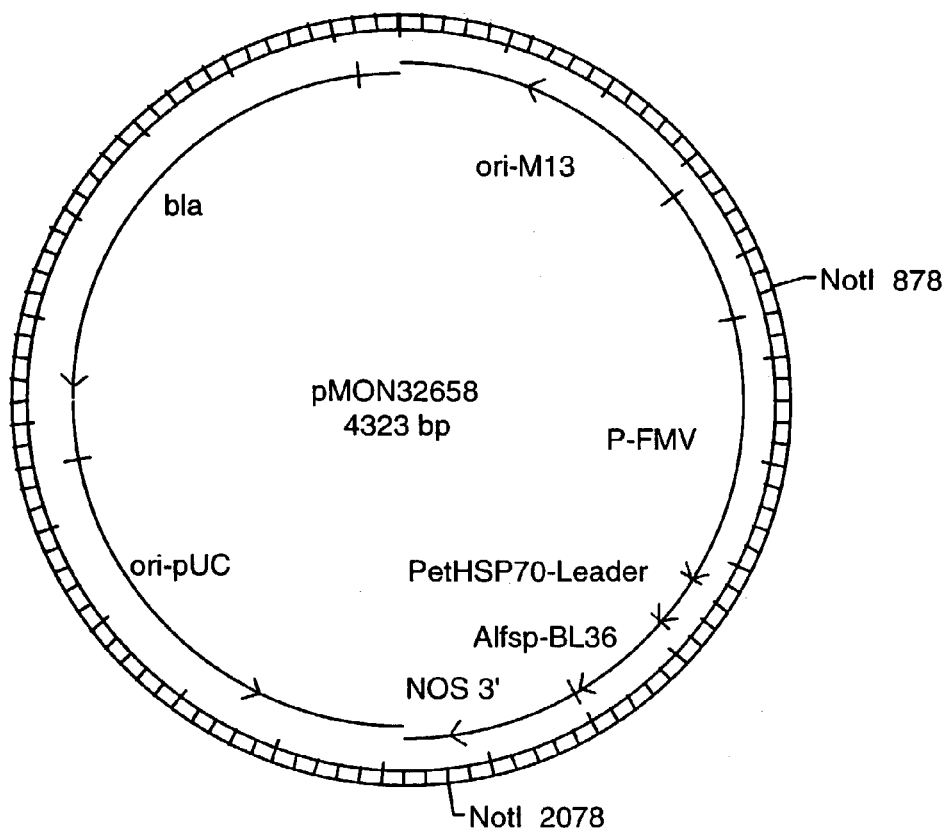
FIG. 5 is a plasmid map of pMON32658.

After cloning the fusion sequence into pMON11770, the vector was digested with restriction enzyme NotI. This liberated a fragment containing the entire expression cassette (i.e., 5'FMV promoter, Hsp70 leader sequence, AlyAFP signal sequence/fcwp1 fusion, and nos3'). This expression cassette was then inserted into the double border plant transformation vector pMON17227. The resulting plasmid was designated pMON21454 (FIG. 2).

The pMON21454 vector contains the following sequence elements linked in the 5' to 3' direction: an FMV promoter; Spc/Str, conferring resistance to spectinomycin and streptomycin; the right border region of the T-DNA; 5-enolpyruvyl-3-phoshoshikimate synthase (EPSPS) sequence, conferring resistance to glyphosate; the E9 3' sequence, a transcriptional termination site and polyadenylation signal sequence; an FMV promoter; the Hsp70 leader sequence; the AlyAFP signal/fcwp1 fusion; the nos 3' sequence; the left border of the T-DNA; and the origin of replication (ori-322).

Example 8

Purification of mRNA

Total cellular RNA was harvested from partially lyophilized *Fusarium culmorum* germinated spores using the TRIZOL Reagent kit (TRIZOL is a registered trademark of GIBCO BRL/Life Technologies, Inc., Gaithersburg, Md.), according to the manufacturer's protocol. The harvested RNA was further purified using oligo(dT) cellulose (GIBCO BRL/Life Technologies, Gaithersburg, Md.) as described by Celano et al. (1993).

Example 9

Synthesis of the First Strand of cDNA

The purified poly-A RNA from Example 8 was used as a template for reverse transcription PCR (RT-PCR) using a poly-A oligonucleotide primer. This reverse transcription reaction was performed using the 5' RACE Kit (GIBCO BRL/Life Technologies, Gaithersburg, Md.), according to the manufacturer's instructions. The reaction yielded a first strand of the cDNA. After removal of the mRNA strand by RNase H1 digestion and spin cartridge separation, a poly-C tail was added to the single-stranded fcwp1 cDNA using a terminal deoxynucleotide transferase under conditions recommended by the enzyme manufacturer. The 5' region of the gene was amplified by PCR using the GeneAmp DNA Amplification Reagent Kit (Perkin Elmer Cetus) and the reaction conditions recommended by the manufacturer.

Example 10

Amplification and Sequencing of the 5' End of the cDNA

The first strand of the fcwp1 cDNA was used in a PCR reaction to produce a double-stranded cDNA. The two primers used for amplification were (1) a mixed oligonucleotide 34-mer (SEQ ID NO:12) with 14 nucleotides providing restriction sites and 20 nucleotides complementary to the 3' end of the fcwp1 cDNA strand, and (2) an oligo-dG primer (SEQ ID NO:13) that anneals to the poly-C tail of the fcwp1 cDNA strand.

PCR reaction products were analyzed by agarose gel electrophoresis, and a single nucleic acid band of about 480 base pairs was present in the complete reaction mixture, but not in the control reaction mixture that contained only one primer. This band was cut out of the gel, and the DNA was isolated using an Ultrafree-MC centrifugation filter unit (Millipore, Bedford, Mass.). The DNA fragment was digested with BamH1 and cloned into the plasmid pGEM11Zf (+) (Promega, Madison, Wis.).

The inserted fcwp1 5' cDNA was sequenced on a Applied Biosystems 373 DNA Sequencer Stretch Model using the PRISM Ready Reaction Dideoxy Terminator Cycle Sequencing Kit (Applied Biosystems, Inc., Foster City, Calif.). The 5' fcwp1 cDNA sequence is shown in SEQ ID NO:14.

Example 11

Amplification and Sequencing of the 3' End of the cDNA

The 3' region of the fcwp1 cDNA was cloned as follows: First strand cDNA generated for 5' RACE was used as template for the amplification of the 3' portion of the fcwp1 cDNA strand by PCR using the GeneAmp DNA Amplification Reagent Kit (Perkin Elmer Cetus, Norwalk, Conn.). The reaction was performed according to the manufacturer's instructions.

The two primers used for amplification were (1) an oligonucleotide 37-mer (SEQ ID NO:15) with 14 nucleotides for cloning sites and 23 nucleotides complementary to positions 268 to 288 of the 5' fcwp1 cDNA sequence; and (2) an oligo-dT primer (SEQ ID NO:16) that anneals to the poly(A) tail of the fcwp1 cDNA. PCR reaction products were analyzed by agarose gel electrophoresis. A single nucleic acid band of about 550 base pairs was present in the complete reaction mixture, but not in the control reaction mixture containing only one primer. This band was cut out of the gel, and the DNA was isolated using an Ultrafree-MC centrifugation filter unit (Millipore, Bedford, Mass.). The DNA fragment was digested with BamHI, cloned into the plasmid pGEM11Zf (+) (Promega), and sequenced as described previously. The 3' fcwp1 sequence is shown in SEQ ID NO:17.

Example 12

Amplification of the Full Length cDNA

The 5' region (SEQ ID NO:14) and the 3' region (SEQ ID NO:17) of fcwp1 cDNA overlapped by 193 nucleotides. A full-length fcwp1 cDNA, as shown in SEQ ID NO:18, was formed by combining nucleotides 1 to 454 of SEQ ID NO:14 with nucleotides from position 202 to the end of SEQ ID NO:17 in a PCR reaction as described previously.

As shown in FIG. 3, the fcwp1 cDNA contains a 90-base-pair 5' leader sequence, a 408-base-pair open reading frame coding for a 136-amino-acid protein, and a 3' untranslated region of 213 base pairs leading up to the poly(A) tail.

The fcwp1 cDNA is capable of encoding a protein of up to 136 total amino acids. Amino acids 95-136 comprise the FCWP1 protein of SEQ ID NO:1.

Example 13

Identification of Related Sequences

The Gen EMBL database was searched using FastA with the BLOSUM 50 scoring matrix on GCG software (Genetics Computer Group, Inc., Madison, Wis.) in order to identify any sequences closely related to FCWP1 or fcwp1. The sequence sharing the greatest sequence identity with FCWP1 was the ribosomal protein RPG19, isolated from *Rhizomucor racemosus* (Sosa et al., 1989). The amino acid sequence of FCWP1 was aligned with the amino acid sequence of RPG19 (FIG. 4). The FCWP1 protein is underlined. The two proteins display 58% identity.

Example 14

Detection of Purified FCWP1

Purified FCWP1 was spiked into boiled Russet Burbank crude leaf extracts and into boiled potato leaf intercellular wash fluid (pIWF). Protein extracts from the leaves were then prepared in a grinding buffer (20% (w/v) SDS, 10% (v/v) glycerol, 0.125 M Tris, pH 8.45) and analyzed by SDS polyacrylamide gel electrophoresis (SDS PAGE). Tricine gels (Novex, San Diego, Calif.) were used to enhance separation of low molecular weight proteins. After electrophoresis, the proteins were electrophoretically transferred to IMMOBILON-P PVDF microporous membrane (IMMOBILON is a registered trademark of Millipore, Bedford, Mass.). Following transfer, the membranes were blocked with 5% (w/v) dry milk in TBST (10 mM Tris, 0.15 M NaCl, 0.05% (v/v) Tween-20, at pH 8.0).

After blocking, the membrane was probed with anti-FCWP1 polyclonal antibody. The rabbit polyclonal antibodies against FCWP1 protein were prepared by Pocono Rabbit Farm (Canadensis, Pa.). The antibody had been preadsorbed to crude Russet Burbank leaf tissue extract to reduce non-specific binding of the antibody to proteins normally found in potato leaf tissue. After several washes, the membrane was incubated with a secondary anti-rabbit antibody labeled with horseradish peroxidase (Amersham Corp., Arlington Heights, Ill.). Detection of the antibody specific bands was accomplished using an enhanced chemiluminescence procedure in which light-emitting bands are visualized by exposure of the membrane to film (ECL Western Blotting kit, Amersham, Arlington Heights, Ill.). The size of the FCWP1 protein was estimated to be 5 kDa.

Example 15

Isolation of Potato Intercellular Wash Fluid

Potato intercellular wash fluid (pIWF) was isolated from eight freshly harvested Russet Burbank potato leaves. Medium-sized leaves were cut from the plants near the base of the leaf and were immediately placed in distilled, deionized water. The leaves were transferred to a 1 L vacuum flask containing approximately 350 mL distilled, deionized water. A vacuum was applied to the flask for 10-15 seconds to remove air from the intercellular spaces. The vacuum was then quickly released to promote saturation of the intercellular spaces with water. This infiltration was repeated 3-4 times. The leaves were removed from the water and blotted dry. The leaves were then rolled and placed into a syringe. Intercellular wash fluid was harvested by centrifugation at about 300×g. The wash fluid was then cleared of any dark green pigment by centrifugation at 16,000×g for 10 minutes in a tabletop microfuge. The pIWF was then stored on ice until use.

Example 16

Determination of FCWP1 Proteolysis Sites

The FCWP1 proteolysis sites were determined by mass spectrometry. Freshly isolated pIWF was diluted 1:5 with 50 mM MES buffer pH 6.0 (Sigma Co., St. Louis, Mo.), to yield a final protein concentration of 114 µg/mL. FCWP1 was diluted in 50 mM MES, pH 6.0 to give a final protein concentration of 200 µg/mL. To initiate proteolysis, 5 µL of FCWP protein was added to 5 µL of pIWF. Proteolysis was allowed to proceed for 0.5, 0.75, 1, 2, and 5 minutes. The proteolysis was terminated by placing the sample in a boiling water bath for 4 minutes. The samples were frozen in dry ice and stored until analysis by MALDI-TOF (matrix-assisted laser desorption/ionization time-of-flight) mass spectrometry to compare the pattern of molecular weights of the proteolytic fragments with that of the parent protein.

For analysis, the protein samples were diluted 1:10 into a matrix solution comprising 10 mg/mL α-cyano-4-hydroxycinnamic acid dissolved in 60% acetonitrile, 20% methanol, 0.3% trifluoroacetic acid, and 20% water. An aliquot (1 µL) was spotted on a sample plate for analysis. Control samples included pIWF without added protein, and boiled (denatured) pIWF with protein.

Proteolytic analysis of FCWP did not reveal any obvious sequence-dependent cleavage sites. To aid in the identification of proteolytic consensus sites, other ribosomal protein sequences were analyzed. These included YL46 (SEQ ID NO:34), SL23 (SEQ ID NO:33), and BL32 (SEQ ID NO:31). Analysis was performed as described above. The sequences were then converted from the 20 amino acid code into a code that groups amino acids together based on common physical properties (amino acid abbreviations correspond to the single letter code). The code for each amino acid is as follows:

Polar (G, S, T, C, N, Q, P, H)=1
Hydrophobic (A, V, L, I, M, F, W, Y)=0
Basic (K, L)=(+)
Acidic (E, D)=(−)

The FCWP and ribosomal protein sequences were converted from the 20 amino acid code to a 4 "letter" code using the guide above. From this code, a "loose" consensus appeared for approximately half of the sites: . . . 1 0*(+/1)*1 1 . . . (in which the symbol * indicates a proteolytic site). Every occurrence of this pattern resulted in hydrolysis at both cut sites.

Example 17

Construction of FCWP1 Variants

A number of variants that contained altered proteolytic sites were synthetically produced (SEQ ID NOS:19-24). The protein sequences and proteolytic sites of the parent protein (FCWP1) and the variants are shown in Table 4. FCWP1 is the wild-type protein. Mutated residues are indicated by text in bold. A * indicates a site of proteolysis.

TABLE 4

Various FCWP Proteins

| Protein (SEQ ID NO) | Sequence |
| --- | --- |
| FCWP1 (1) | VKVGLA*TKAERASRQQRKQRKNRQKTL*R*GTA*KVKGAKAKK |
| FCWP2 (19) | VKVGLA*TKAERASRQQRKQRKNRQKTL*M*GTA*KVKGAKAKK |
| FCWP3 (20) | VKVGLA*TKAERASRQQRKQRKNRQKTR*RG*TA*KVKGAKAKK |

TABLE 4-continued

Various FCWP Proteins

| Protein (SEQ ID NO) | Sequence |
|---|---|
| FCWP4 (21) | VKVGLA*TKAERASRQQRKQRKNRQKTL*R*GTA*QVKGAKAKK |
| FCWP5 (22) | VKVGLA*TKAERASRQQRKQRKNRQKTL*R*GTR*KVKGAKAKK |
| FCWP6 (23) | VKVGLA*TKAERASRQQRKQRKNRQKTL*M*GTA*QVKGAKAKK |
| FCWP7 (24) | VKVGLA*TKAERASRQQRKQRKNRQKT*RRG*TR*KVKGAKAKK |

Example 18

Testing of FCWP 2-7 for Resistance to Proteolysis

Due to the susceptibility of the FCWP1 parent protein to proteolysis, a gel assay was used to evaluate the susceptibility of the mutants to proteolysis. The variants of FCWP1 were subjected to proteolysis by pIWF for 5 minutes under the conditions described previously. The degree of protein degradation was determined by analysis on 16.5% Tricine-SDS polyacrylamide gels (Bio-Rad, Hercules, Calif.) with visualization of the proteins by silver staining (Novex, San Diego, Calif.).

The results indicated that FCWP5, FCWP6, and FCWP7 were more resistant than the other FCWP proteins to proteolysis in potato intercellular wash fluid in vitro. The protease susceptible sites of the variants were further characterized by limited proteolysis and MALDI-TOF mass spectrometry as described previously. This analysis confirmed that FCWP5, FCWP6, and FCWP7 were more resistant to proteolysis.

Example 19

Testing the Antifungal Activity of FCWP 2-7 Proteins

Each of the FCWP proteins was tested in an antifungal activity assay (as described in Example 4). The results are listed in Table 5. All the variant proteins tested possessed antifungal activity against *Phytophthora infestans* at concentrations similar to that of the wild-type protein. The minimum inhibitory concentration was in the range of 10-25 ppm for all proteins. Notably, FCWP7 retained its antifungal activity for 60 hours. By comparison, wild-type FCWP1 has no activity at 60 hours.

In a separate assay, antifungal activity was assessed in the presence of dilute amounts of pIWF (i.e., under conditions of proteolysis). These assays demonstrated that FCWP3, FCWP5, and FCWP7 retained full activity in the presence of pIWF where the wild-type protein is only slightly active.

TABLE 5

Activity and Stability of FCWP Proteins against *P.infestans**

| Protein | IC$_{50}$ (24 hours) | IC$_{50}$ (60 hours) |
|---|---|---|
| FCWP1 | 15 ppm | >100 ppm |
| FCWP2 | 25 ppm | >100 ppm |
| FCWP3** | 25 ppm | >100 ppm |
| FCWP4 | 20 ppm | >100 ppm |
| FCWP5** | 50 ppm | >100 ppm |
| FCWP6 | 25 ppm | >100 ppm |
| FCWP7** | 10 ppm | 25 ppm |

*Concentrations of protein tested were 100 ppm, 50 ppm, 10 ppm, 2 ppm, and 1 ppm.
**These proteins also retained their activity at 50 ppm in the presence of 10 ppm pIWF.

The proteins were also tested in the assay against *Verticillium dahliae*. Stocks of the proteins were prepared in 50 mM HEPES buffer, pH 7.5. A 10 µL suspension of *Verticillium dahliae* conidia was added to 10 µL of protein solution. The spores were allowed to germinate at room temperature for about 4 hours. After germination, the protein was added and the assay incubated at room temperature overnight. Inhibition of fungal growth was determined by microscopic evaluation of the fungal/protein mixture. Again, all the FCWP proteins demonstrated antifungal activity similar to the wild-type protein (Table 6). The proteins were assayed at final concentrations of 25 ppm and 10 ppm and an average inhibitory concentration was determined.

TABLE 6

Activity of FCWP Proteins against *Verticillium dahliae*.

| Protein | IC$_{50}$ (24 hours) |
|---|---|
| FCWP1 | 10 ppm |
| FCWP2 | 20 ppm |
| FCWP3 | 10 ppm |
| FCWP4 | 20 ppm |
| FCWP5 | <10 ppm |
| FCWP6 | 25 ppm |
| FCWP7 | <10 ppm |

Example 20

Construction of Plasmids Containing fcwp2-7

The recombinant vector pMON21454 (constructed in Example 7), was used as a PCR template to produce nucleic acid sequences that encode SEQ ID NOS:19-24 (FCWP2-7, respectively). Primers consisted of a 5' oligomer (SEQ ID NO:7) and a unique oligomer complementary to the 3' end of each of the respective fcwp sequences. Each of these 3' oligomers (SEQ ID NOS: 25-30) was designed to incorporate either a single or double amino acid substitution in the resulting amino acid sequence. Each oligomer was also designed to introduce a BamHI restriction site after the stop codon. In this manner, fcwp2-7 were produced.

PCR products were produced and gel purified as described previously. The purified DNA fragments were digested with BamHI and ligated into plasmid pMON22575 to produce pMON 32682-32687, which correspond to fcwp variants 7, 2, 3, 4, 5, and 6, respectively.

The sense orientation and DNA sequence of each variant was verified and the NotI fragment containing the gene expression cassette was subcloned into a binary vector pMON26140.

Example 21

Identification of Proteins Related to FCWP1

Protein and nucleic acid databases were searched in an attempt to identify sequences related to FCWP1. No sequences were found with significant sequence homology. Proteins falling in the same class of antifungal proteins were identified by searching in the public sequence databases using the search string "ribosom." The software used for searching was the LookUp program supplied with GCG version 9.1 (Genetics Computer Group, Inc., Madison, Wis.). The set of sequences returned was edited by a biologist to eliminate sequences that were not ribosomal proteins. The edited set was then searched using IsoSearch.

The predicted isoelectric point (pI) of each protein was calculated using the HasIsoPoint algorithm in GCG version 9.1 pK data was obtained from the isoelectric.dat table supplied with GCG version 9.1. (Bull, 1964). Protein mass was calculated using the average atomic masses of unhydrated amino acids derived from the aafreq.dat table supplied with GCG version 9.1.

A group of related proteins was discovered that had similar values for pI and molecular weight (SEQ ID NOS: 37-1753). These proteins were ribosomal and typically had a pI greater than 7 and a molecular weight below about 20 kDa. A representative number of proteins from this group were selected and tested for antifungal activity. The assay was performed as described previously. The related proteins displayed significant antifungal activity (Table 7).

TABLE 7

Antifungal Activity of Ribosomal Proteins Related to FCWP1.

| Protein | SEQ ID NO: | # AA | Molecular Weight (Da) | pI | IC$_{50}$ (µM) P. infestans | IC$_{50}$ (µM) F. culmorum |
| --- | --- | --- | --- | --- | --- | --- |
| FCWP1 | 1 | 40 | 4504 | 12.14 | 5 | 5 |
| YL41 | 35 | 25 | 3337 | 12.96 | 4.5 | 1.2 |
| YL46 | 34 | 50 | 6228 | 12.55 | 6.4 | 1.3 |
| SL23 | 33 | 44 | 5192 | 12.13 | 7.7 | 2.5 |
| BL36 | 32 | 37 | 4427 | 12.91 | 3.4 | 2.3 |
| BL32 | 31 | 52 | 6061 | 12.05 | 6.6 | 1.6 |

Example 22

Production of Transformed Plant Cells

The recombinant vectors from Example 20 were used to transform *Agrobacterium tumefaciens* via electroporation. Plasmids pMON32684, pMON32686, pMON32687, and pMON32682 (corresponding to FCWP variants 3, 5, 6, and 7, respectively) were used to generate transgenic potato plants via *Agrobacterium*-mediated transformation of potato plant cells (Fraley et al., 1983).

Example 23

Testing Transgenic Potato Plants for Resistance to *Phytophthora infestans*

Russet Burbank potato plants (*Solanum tuberosum*) producing FCWP proteins will be tested for resistance to fungal infections. Transgenic and non-transgenic plantlets will be propagated from callus (soft tissue that forms over a wounded or cut slant surface). When plantlets reach approximately 1-2 inches tall, the plants will be removed from the medium and transplanted into 6-inch pots containing Metro-Mix 350 (Hummert Seed Co., St. Louis) and placed in a growth chamber. Six pots with three to four shoots each (10 leaves with 5-7 leaves/shoot, 4-5 weeks after transplanting) will be used for each test.

The potato plants will be challenged with an inoculation of *Phytophthora infestans*. The *Phytophthora infestans* sample will preferably be introduced as an infected potato tissue (foliage or stems).

*P. infestans* is typically isolated by placing infected tissue directly underneath fresh potato tuber slices in sterile 9-cm petri plates. Mycelia of *P. infestans* grow through the tuber slices and sporulate within approximately 7-10 days. Sporangia produced by mycelia grow through the tuber slices and are transferred to fresh media on a small agar block. Using this method, a clean culture is obtained without the need for selective media. Long-term culture of the isolate is achieved by maintaining the culture on a medium such as rye A agar medium (Caten and Jinks, 1968)

A preferred *Phytophthora infestans* isolate for use in disease tests would be the most agronomically significant isolate available, which currently is US-8, mating type A2. *Phytophthora* isolates generally are typed by comparison profiles of enzymes electrophoretically using a known Pi strain as a standard.

For inoculation, a *P. infestans* sporangial suspension will be prepared using cold (4° C.) deionized distilled water with approximately $1 \times 10^4$ sporangia per milliliter. The *P. infestans*, for example US-8, will be inoculated onto the leaf surface of the plants with the aid of a spray gun such as a DeVilbiss EGA-502 (Sunrise Medical Co., Somerset, Pa.) or equivalent method. Inoculated plants will then be placed in a moist growth chamber at approximately 17° C. in the dark for approximately 40 hours. Next, the plants will be transferred to a growth chamber for subsequent analysis of fungal disease symptoms. The growth chamber conditions will be approximately 18° C., 12 hr light per day, and about 320 µE per square meter per second.

Disease severity will generally be assessed at two different time points. At 4- and 7-days post-inoculation, the plants will be scored based on the percentage of diseased leaf tissue and compared with appropriate controls.

The plants produced in this fashion may include nucleic acid sequences encoding the wild-type FCWP1, the FCWP 2-7 variants, other modified forms of FCWP1, and other related ribosomal proteins identified on the basis of their high pI and low molecular weight such as SEQ ID NOS: 31-35.

Example 24

Production of a Nucleic Acid Sequences Encoding the BL36 Protein

The BL36 antifungal protein consists of 37 amino acids. Using the amino acid sequence of SEQ ID NO:32, a nucleic acid molecule encoding BL36 was constructed by PCR.

Due to the degeneracy of the genetic code, several codons are possible for any particular amino acid. Each type of cell or organism, however, has a preferred pattern of codon usage. The codon usage was selected such that it was optimal for dicots or monocots. Optimal codon usage was determined as described (Murray et al., 1989) and codon frequency table for potato or maize in Wisconsin GCG software package (Genetics Computer Group, Inc., Madison, Wis.).

The bl36 synthetic gene was fused to a second nucleic acid sequence encoding a signal peptide from the AlfAFP protein. The signal sequence is described in U.S. patent application Ser. No. 09/003,198. Immunohistochemical studies indicated that this signal peptide functions to target the protein to the extracellular space of plant tissue.

Reactions (3' extension of the annealed PCR products and the PCR amplification of the full length sequence) of overlapping oligonucleotides were conducted in a single tube, in a single PCR reaction using the Long Range Template PCR kit (Boehringer Mannheim Corp., Indianapolis, Ind.) following the conditions suggested by the manufacturer to produce full-length synthetic genes (SEQ ID NO:37 for the bl36 potato synthetic gene and SEQ ID NO:36 for the bl36 wheat synthetic gene. The kit included all the necessary enzymes and buffers. Oligonucleotide primers were produced by Midland Certified Reagent Co., (Midland, Tex.). Convenient restriction sites were added to the ends to facilitate subcloning. The final PCR product was separated on a 2% agarose gel, and a nucleic acid band of about 140 base pairs was visualized after ethidium bromide staining. This nucleic acid band was purified from the gel and ligated into plasmid (Invitrogen, San Diego, Calif.).

The sequence of the synthetic gene was confirmed using a 373 DNA Sequencer Stretch Model from Applied Biosystem using the PRISM Ready Reaction Dideoxy Terminator Cycle Sequencing Kit following the manufacturer's instructions (Applied Biosystems, Inc., Foster City, Calif.).

Figure 6:
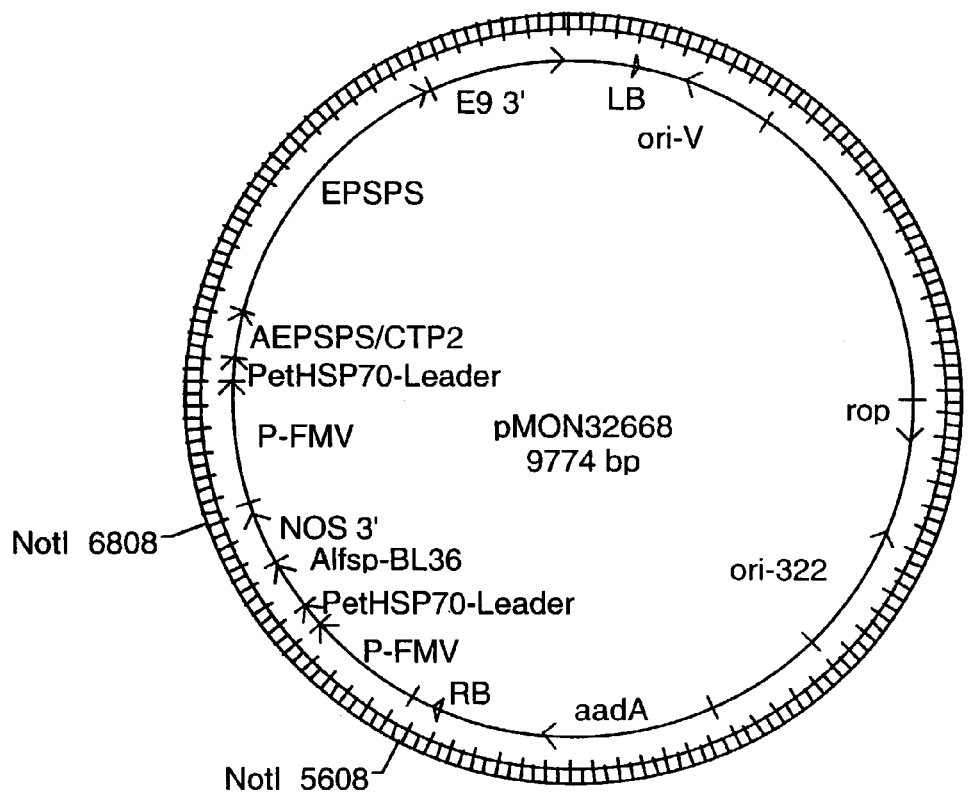
FIG. 6 is a plasmid map of pMON32668.

For the potato gene, Bam HI and EcoR I restriction sites were used to subclone the bl36 gene into pMON22575 for expression behind the FMV promoter, resulting in pMON32658. The expression cassette was transferred as a Not I fragment into the double-border plant transformation vector pMON21460 to produce pMON32668 (FIG. 6). Potato plants were transformed with pMON32668 using the method in Example 22 and tested for disease resistance by the method in Example 23. No disease resistance was seen.

Figure 7:
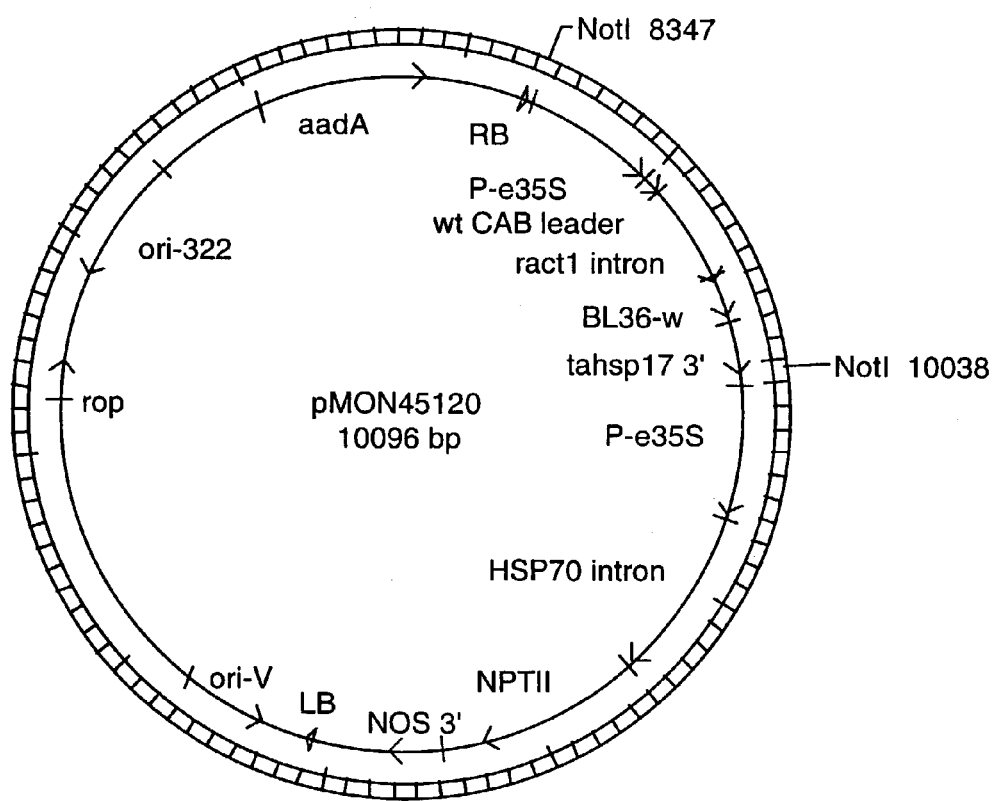
FIG. 7 is a plasmid map of pMON45120.

For the wheat gene, the PCR produced synthetic gene was ligated into pMON32619, behind the e35S promoter at Nco I and Eco RI to produce pMON21465. The Not 1 cassette was mobilized into the double-border plant transformation vector pMON36147 to produce pMON45120 (FIG. 7).

Transformation of Wheat

For transformation of wheat plants, pMON45120 was used and the following procedure was followed.

1. Explant Preparation

Immature embryos of wheat (*Triticum aestivum* L) cv Bobwhite were isolated from the immature caryopsis (wheat spikelets) 13-15 days after pollination, and cultured on CM4C (Table 8) for 3-4 days. The embryos without embryogenic callus were selected for *Agrobacterium* inoculation.

TABLE 8

Supplemental Components in Basal Media[1]

| Components | CM4 | CM4C | MMS.2C | MMS0 |
|---|---|---|---|---|
| 2,4-D (mg/L) | 0.5 | 0.5 | 0.2 | — |
| Pichloram (mg/L)[2] | 2.2 | 2.2 | | |
| Maltose (g/L) | 40.0 | 40.0 | 40.0 | 40.0 |
| Glutamine (g/L) | 0.5 | 0.5 | | |
| Magnesium Chloride (g/L) | 0.75 | 0.7 | | |
| Casein Hydrolysate (g/L) | | 0.1 | 0.1 | |
| MES (g/L) | | 1.95 | 1.95 | 1.95 |
| Ascorbic Acid (mg/L)[2] | 100.0 | 100.0 | 100.0 | |
| Gelling Agent (g/L)[3] | 2(P) | 2(P) | 2(G) | 2(G) |

[1]All media contain basal salts (MS basal salts) and vitamins (MS vitamins) from Murashige and Skoog (1962). The pH in each medium was adjusted to 5.8.
[2]Filter-sterilized and added to the medium after autoclaving.

[3]PHYTAGEL (P) (PHYTAGEL is a registered trademark of Sigma Chemical Co., St. Louis, Mo.) or GELRITE (G) (GELRITE is available from Schweizerhall, Inc., South Plainfield N.J.) (GELRITE is a registered trademark of Monsanto Company, St. Louis, Mo.).

2. *Agrobacterium* Culture and Inoculation

A disarmed *Agrobacterium* strain C58 (ABI) harboring a binary vector was used for all the experiments. Cultures of *Agrobacterium* were initiated from glycerol stocks or from a freshly streaked plate and grown overnight at 26° C.-28° C. with shaking (approximately 150 rpm) to mid-log phase (about $OD_{660}$=1-1.5) in liquid LB medium, pH 7.0 (Miller, 1972) containing 50 mg/L kanamycin, 50 mg/L streptomycin and spectinomycin, and 25 mg/L chloramphenicol with 200 µM acetosyringone (AS). The *Agrobacterium* cells were resuspended in the inoculation medium and the density was adjusted to an $OD_{660}$ of 1. The immature embryos cultured in CM4C medium were transferred into sterile petri plates (16×20 mm) or wells of a 6-well cell culture plate (Costar Corporation, Cambridge, Mass.) containing 10 mL of inoculation medium per petri plate or 5 mL per cell culture cluster plate. An equal amount of the *Agrobacterium* cell suspension was added such that the final concentration of *Agrobacterium* cells was an $OD_{600}$ of 0.5 or in some experiments 0.25. In most experiments, pluronic F68 was added to the inoculation mixture at a final concentration of 0.01%. The ratio between the *Agrobacterium* and immature embryos (IEs) was about 10 mL: 20-200 IEs. The conditions for inoculation were temperatures from 23° C.-26° C. with a duration from 25-30 minutes.

3. Co-Culture

After the inoculation period, the remaining *Agrobacterium* cells were removed from the explants by using the in-house vacuum equipment. A piece of sterile Whatman No. 1 filter paper (to fit the size of the petri plate) was placed in each of 60×15 or 60×20 mm petri dishes. One hundred and seventy-five to one hundred and ninety microliters of sterile water was placed in the middle of the filter paper. After 2-3 minutes, the inoculated immature embryos were placed in the plates. Usually, 20-50 explants are grouped as one stack (about 1 cm in size and 60-80 mg/stack), with 4-5 stacks on each plate. The plates were immediately parafilmed and then co-cultivated in the dark at 24° C.-26° C. for 2-3 days.

4. Selection and Regeneration

After 2-3 days on the delay medium, the immature embryos were transferred to CM4C supplemented with 25 mg/L G418 and 500 mg/L carbenicillin. After 2-3 weeks, the embryos were broken into smaller pieces (~2 mm) and subcultured to the first regeneration medium, MMS.2C (Table 8) with 25 mg/L G418 and 250 mg/L carbenicillin. Upon transfer to the regeneration medium, each piece of callus was further divided into several small pieces (~2 mm). Two weeks post-transfer, young shoots and viable callus tissue were transferred to a second regeneration medium MMS0C (Table 8) with the same concentrations of G418 and carbenicillin. Larger pieces of tissues were separated into smaller pieces as previously described. Plantlets, which were confirmed later to be true transformants, grew vigorously and formed strong root systems on this medium. The plants with strong root hairs, with more than ten short and strong roots, or secondary roots, were transferred to Sundae cups (Sweetheart Cup Company, Chicago, Ill.) containing the second regeneration medium for further growth and selection. During the growth period in the Sundae cups, most of the non-transformants died or showed signs of susceptibility to G418. The plants highly resistant to G418, which grew vigorously with strong root systems, were transferred to soil before they grew to the top of the Sundae cups. All the plants that originated from the same embryo were considered to be siblings from the same event.

5. Detection and Analysis of the Transgenic Plants

The plants were grown in an environmentally controlled growth chamber with a 16-hour photoperiod at 800 molm$^{-2}$s$^{-1}$ provided by high-intensity discharge (HID) Sylvania lights (GTE Products Corp., Manchester, N.H.). The day/night temperatures were 18/16° C. It took about 2.5 to 3 months from inoculation to transferring most of the plants to soil, and no visible abnormalities were observed. Each plant is tested for disease activity as described below.

Two experiments were conducted to evaluate the activity of BL36 using e35S promoter (pMON45120) in wheat to control *Fusarium* head blight (*Fusarium graminearum*) and Glume Blotch (*Stagonospora nodorum*) in the growth chamber.

In these experiments a total of 37 BL36 transgenic lines were submitted for the *Fusarium* head blight (*F. graminearun*) and Glume Blotch (*S. nodorum*) disease testing. Both experiments were arranged in a randomized complete block design, replicated 5 times for each disease. For comparison, in both experiments, 37 BL36 negative lines and 37 non-transgenic susceptible Bobwhite plants were included to benchmark the efficacy of the BL36 positive transgenic lines.

In the *Fusarium* head blight (*F. graminearum*) experiment, transgenic wheat lines have been assayed using the point inoculation technique. Wheat heads were inoculated with a mycelial plug of *F. graminearum* when the flowers were in the process of anthesis or when the head already extruded anthers. The first disease evaluation was performed 5 days after inoculation by counting the number of spikelets that exhibited disease symptoms. Evaluations were repeated at 2 day intervals for a total of 6 times. Disease severity was expressed as the percentage of diseased spikelets per spike for each time point. To test the overall treatment effect, the area under disease progress curve (AUDPC) was calculated for each transgenic plant. In this experiment, six of the 37 lines had a lower AUDPC than the controls.

In the Glume Blotch (*Stagonospora nodorum*) experiment, conidial suspension of *S. nodorum* used for inoculation was adjusted to 2×106 spores per milliliter. Inoculated plants were then placed in a mist chamber for 78 hours before moved to the growth chamber. Plants were rated at 7 and 14 days after inoculation. In this experiment, each plant was visually assessed and rated as the mean percent glume diseased on a scale 0-100%. The average percent disease for the negative plants was 63%. Twenty-four of the 37 BL36 plants had a lower percent disease, with the lowest being 45%.

All publications and patent applications mentioned in this specification are indicative of the level of skill of those skilled in the art to which this invention pertains. All publications and patent applications are herein incorporated by reference to the same extent as if each individual publication or patent application was specifically and individually indicated to be incorporated by reference.

Although the foregoing invention has been described in some detail by way of illustration and example for purposes of clarity of understanding, it will be obvious that certain changes and modifications may be practiced within the scope of the appended claims.

REFERENCES

Ainley et al., *Plant Mol. Biol.* 14: 949, 1990
Ausubel et al., *Current Protocols in Molecular Biology*, John Wiley and Sons, Inc., 1995.
Back et al., *Plant Mol. Biol.* 17: 9, 1991
Bauer et al., *Gene*, 37: 73, 1985.
Bol et al., *Ann. Rev. Phytophathol*, 28: 13-138, 1990.
Bowles, *Ann. Rev. Biochem*, 59: 873-907, 1990.
Brears et al., *Agro-Food-Industry Hi-Tech.*, 10-13, 1994.
Broekaert et al., *Plant Physiol.*, 108:1353-1358, 1995.
Broekaert et al., *Critical Reviews in Plant Sciences*, 16(3): 297-323, 1997.
Bull, *An Introduction to Physical Biochemistry*, Philadelphia, F. A. Davis, Co, p. 128, 1964.
Bustos et al., *EMBO J.* 10: 1469-1479, 1991.
Campbell et al., *Plant Physiol.*, 92: 1-11, 1990.
Capecchi, *Cell*, 22(2): 479-488, 1980.
Castresana et al., *EMBO J.* 7: 1929-1936, 1988
Caten and Jinks, *Canadian Journal of Botany*, 46: 329, 1968.
Celano et al., *Biotechniques*, 1:26-28, 1993.
Cerda-Olmedo et al., *J. Mol. Biol.* 33: 705-719, 1968
Chau et al., *Science*, 244:174-181. 1989.
Christensen et al., *Plant Mol. Biol.*, 18: 675, 689, 1992.
Clapp, *Clin. Perinatol.*, 20(1): 155-168, 1993.
Costa et al., *Methods Mol. Biol.* 57: 31-44, 1996
Craik, *BioTechniques*, 3: 12-19, 1985.
Curiel et al., *Hum. Gen. Ther.*, 3(2):147-154, 1992.
Cuypers et al, *Mol. Plant-Microbe Interact*, 1: 157-160, 1988.
Davey et al., *Symp. Soc. Exp. Biol.* 40: 85-120, 1986.
Davey et al., *Plant Mol. Biol.* 13(3): 273-285, 1989.
Deng and Nickloff, *Anal. Biochem.* 200: 81, 1992
Doyle et al., *J. Biol. Chem.* 261: 9228-9238, 1986
Eglitis and Anderson, *Biotechniques*, 6(7): 608-614, 1988.
Feinbaum et al., *Mol. Gen. Genet.* 226: 449-456, 1991
Fraley et al., *Proc. Natl. Acad. Sci. U.S.A.*, 80: 4803, 1983.
Frits Eckstein et al., *Nucleic Acids Research*, 10: 6487-6497, 1982.
Fritzemeier et al., *Plant Physiol.*, 85: 34-41, 1987.
Fromm et al., *Proc. Natl. Acad. Sci. USA*, 82(17): 5824-5828, 1985.
Fynan et al., *Proc. Natl. Acad. Sci. USA*, 90(24): 11478-11482, 1993.
Gasser and Fraley, *Science* 244: 1293, 1989.
Glick et al., Methods in Plant Molecular Biology and Biotechnology, CRC Press, Boca Raton, Fla., 1993.
Graham and Van der Eb, *Virology*, 54(2): 536-539, 1973.
Greener et al., *Mol. Biotechnol.* 7: 189-195, 1997
Guerola et al., *Nature New Biol.* 230: 122-125, 1971
Hershey and Stoner, *Plant Mol. Biol.* 17: 679-690, 1991
Hess, *Intern Rev. Cytol.*, 107: 367, 1987.
Horsch et al., *Science*, 227: 1229-1231, 1985.
Johnston and Tang, *Methods Cell Biol.*, 43(A): 353-365, 1994.
Kares et al., *Plant Mol. Biol.* 15: 905, 1990
Keller et al., *EMBO L.*, 8: 1309-1314, 1989.
Knutzon et al., *Proc. Natl. Acad. Sci. U.S.A.* 89: 2624-2628, 1992
Kridl et al., *Seed Sci. Res.* 1: 209, 1991
Kuhlemeier et al., *Plant Cell* 1: 471, 1989
Kunkel, *Proc. Natl. Acad. Sci. U.S.A.*, 82: 488-492, 1985
Kyte and Doolittle, *J. Mol. Biol.*, 157: 105-132, 1982
Lam and Chua, *J. Biol. Chem.* 266: 17131-17135, 1990

Lam and Chua, *Science* 248: 471, 1991
Laemmli, *Nature,* 227: 680-685, 1970.
Lindstrom et al., *Developmental Genetics,* 11: 160, 1990.
Linthorst, *Crit. Rev. Plant Sci.,* 10: 123-150, 1991.
Logemann et al., *Plant Cell,* 1: 151-158, 1989.
Lu et al., *J. Exp. Med.,* 178(6): 2089-2096, 1993.
Luo et al., *Plant Mol. Biol. Reporter,* 6: 165, 1988.
Mandel et al., *Plant Mol. Biol,* 29: 995-1004, 1995.
Martens K., *Spray Drying Handbook,* Third Edition, G. Goodwin, Ltd., London, 1979.
Martini et al., *Mol. Gen. Genet.,* 263: 179, 1993.
Matton et al., *Mol. Plant-Microbe Interact,* 2: 325-331, 1989.
McElroy et al., *Plant Cell,* 2:163-171, 1990.
Murray et al., *Nucl. Acids Res.,* 17(2):477-498, 1989.
Neuhaus et al., *Theor. Appl. Genet.,* 75: 30, 1987.
Odell et al., *Nature,* 313: 810, 1985.
Osuna et al., *Critical Reviews In Microbiology,* 20: 107-116, 1994.
Ou-Lee et al., *Proc. Natl. Acad. Sci. U.S.A.* 83: 6815, 1986
Park et al., *Plant Molecular Biology,* 32(6): 1135-1148, 1996.
Pena et al., *Nature,* 325: 274, 1987.
Poszkowski et al., *EMBO J.,* 3: 2719, 1989.
Potrykus, et al., *Ann. Rev. Plant Physiol. Plant Mol. Biol.,* 42: 205, 1991.
Pyee et al., *Plant J.,* 7: 49-59, 1995.
Richins et al., *Nucleic Acids Res.* 20: 8451, 1987
Rodriguez, et al. Vectors: A Survey of Molecular Cloning Vectors and Their Uses, Butterworths, Boston, 1988.
Rogan and Bessman, *J. Bacteriol.* 103: 622-633, 1970
Rogers et al., *Meth. In Enzymol,* 153: 253-277, 1987.
Samac et al., *Plant Cell,* 3:1063-1072, 1991.
Sambrook et al., *Molecular Cloning: A Laboratory Manual,* Second Edition, Cold Spring Harbor Laboratory Press, Cold Spring Harbor, N.Y., 1989.
Schroder et al., *Plant J.,* 2: 161-172, 1992.
Schulze-Lefert et al., *EMBO J.* 8: 651, 1989
Simpson, *Science,* 233: 34, 1986.
Singer and Kusmierek, *Ann. Rev. Biochem.* 52: 655-693, 1982
Slighton and Beachy, *Planta* 172: 356, 1987
Smith et al, In: *Genetic Engineering: Principles and Methods,* Setlow et al., Eds., Plenum Press, N.Y., 1-32, 1981.
Sosa et al., *Nucleic Acids Res.,* 17(22): 9319-9331, 1989.
Stayton et al., *Aust. J. Plant. Physiol.* 18: 507, 1991
Terras et al., *J. Biol. Chem.,* 267: 15301-15309, 1992.
Terras et al., *FEBS Letters,* 316(3): 233-240, 1993.
Vandeyar et al., *Gene* 65: 129-133, 1988
Van Tunen et al., *EMBO J.* 7: 1257, 1988.
Vodkin et al., *Cell,* 34: 1023, 1983.
Vogel, et al., *J. Cell Biochem.,* (Suppl) 13D: 312, 1989.
Wagner et al., *Proc. Natl. Acad. Sci. USA,* 89(13): 6099-6103, 1992.
Walder et al., *Gene,* 42: 133, 1986.
Watkins, *Handbook of Insecticide Dust Diluents and Carriers,* Second Edition, Darland Books, Caldwell, N.J.
Weissbach and Weissbach, *Methods for Plant Molecular Biology,* (Eds.), Academic Press, Inc., San Diego, Calif., 1988.
Weisshaar et al., *EMBO J.* 10: 1777-1786, 1991
Wenzler et al., *Plant Mol. Biol.,* 12: 41-50, 1989.
Williams et al., *Biotechnology* 10: 540-543, 1992
Winnacker-Kuchler, *Chemical Technology,* Fourth Edition, Volume 7, Hanser Verlag, Munich, 1986.
Wong and Neumann, *Biochim. Biophys. Res. Commun.,* 107(2): 584-587, 1982.
Worthington and Walker, *The Pesticide Manual,* Seventh Edition, British Crop Protection Council, 1983.
Yamaguchi-Shinozaki et al., *Plant Mol. Biol.* 15: 905, 1990.
Yang and Russell, *Proc. Natl. Acad. Sci. USA,* 87:4144-4148, 1990.
Zatloukal et al., *Ann. N.Y. Acad. Sci.,* 660: 136-153, 1992.
Zhou et al., *Methods in Enzymology,* 101: 433, 1983.

---

SEQUENCE LISTING (1754 sequences)

SEQ ID NO: 1 - protein, 40 aa, Fusarium culmorum
VKVGLATKAERASRQQRKQRKNRQKTLRGTAKVKGAKAKK

SEQ ID NO: 2 - DNA, 126 bp, Artificial Sequence
  synthetic fcwp1 gene
atggttaaggttggtttggctactaaggctgaaagggcttctcgtcaacaaaggaagcaacgtaagaatcgtcaaaagactttgcgtggtactgctaaggttaagggtgctaaggctaagaagtaa

SEQ ID NO: 3 - DNA, 75 bp, Artificial Sequence
  primer
atggttaaggttggtttggctactaaggctgaaagggcttctcgtcaacaaaggaagcaacgtaagaatcgtcaa

SEQ ID NO: 4 - DNA, 77 bp, Artificial Sequence
  primer
ttacttcttagccttagcacccttaaccttagcagtaccacgcaaagtcttttgacgattcttacgttgcttccttt

SEQ ID NO: 5 - DNA, 29 bp, Artificial Sequence
  primer
cccggatccatggttaaggttggtttggc

SEQ ID NO: 6 - DNA, 29 bp, Artificial Sequence
  primer
cccgaattcttacttcttagccttagcac

SEQ ID NO: 7 - DNA, 38 bp, Artificial Sequence
  primer
gggaattcggatccaasaaagtaatagwtatggctaag

SEQ ID NO: 8 - DNA, 41 bp, Artificial Sequence
  primer
gtagccaaaccaaccttaaccaaccttgcatccaccattgt

SEQ ID NO: 9 - DNA, 20 bp, Artificial Sequence
  primer
gttaaggttggtttggctac

SEQ ID NO: 10 - DNA, 30 bp, Artificial Sequence
  primer
ccaggatccttacttcttagccttagcacc

SEQ ID NO: 11 - DNA, 243 bp, Artificial Sequence
  synthetic gene with signal sequence
ggatccaagaaagtaatagttatggctaagtttgctaccatcatctctcttctctttgctgctcttgttctctttgctgcctttgaagcaccaacaatggtggatgcaaggttggttaaggttggtttggctactaaggctgaaagggcttctcgtcaacaaaggaagcaacgtaagaatcgtcaaaagactttgcgtggtactgctaaggttaagggtgctaaggctaagaagtaaggatcc

SEQ ID NO: 12 - DNA, 34 bp, Artificial Sequence
  primer
  unsure (1)..(34): unsure at all n locations
gggaattcggatcctgnckrttyttnckytgytt

SEQ ID NO: 13 - DNA, 30 bp, Artificial Sequence
  primer
  unsure (1)..(30): unsure at all n locations
gggaattcggatccgggnngggnngggnng

SEQ ID NO: 14 - DNA, 470 bp, Artificial Sequence
  synthetic gene (5' end)
  unsure (1)..(470): unsure at all n locations
gggggggggggggggtgacaanttcatcaacgaaacgatntcacccccaacgcccagtttttccaccgtcaacacacccagagaccatcacgacaatcggcaaaaatggcggacaacgactctcccgtcaccctccgaactcgcaagttcatccgcaaccctctgctgggccgtaagcagatggtcgttgacatcctccaccccaaccgtgccaacatctccaaggaggagctccgcgagaagctcggttccccctacaaggcccagaaggaccagatctccgtcttcggtctccgaacccagttcggtggtggcaagaccaccggcttcgctctcgtctatgactcccccgaggccatgaagaagttcgagcctcagtaccgattggtgcgcgttggcctcgccaccaaggccgagcgtgcttcccgacagcagcgcaaacaacgcaaaaaccgccaggatccgaattc

SEQ ID NO: 15 - DNA, 30 bp, Artificial Sequence; identical to SEQ ID NO: 10
  primer

SEQ ID NO: 16 - DNA, 32 bp, Artificial Sequence
  primer
gggaattcggatcctttttttttttttttttt

SEQ ID NO: 17 - DNA, 600 bp, Artificial Sequence
  synthetic gene (3' end)
gaattcggatccagaaggaccagatctccgtcttcggtctccgaacccagttcggtggtggcaagaccaccggcttcgctctcgtctatgactcccccgaggccatgaagaagttcgagcctcagtaccgattggtgcgcgttggcctcgccaccaaggccgagcgtgcttcccgacagcagcgcaagcagcgcaaaaaccgacaaaagactctccgaggtacggcaaaggtcaagggtgccaaggcgaagaaggagaaataaacgattcatggcttggcttgtgtatatcctcgggctggttggggagcggctgctgctatgtctgcagctgcgtgcattcggtggtcatgcgggtgcgtccatttactacggtccatcctcgtcgtcggcgtcggctttggcatagggtacagggacttgctggcggacgcgggggctatctggactcgacgaggggggttgaaggctacgctttcaccttccttgctcaatacactagcatgaaatcaatggtgtttttcgggtttcggaccaaaaacaaaaaatagcaatgtctctggttttcacgaaaaaaaaaaaaaaaaaaggatccgaattc

SEQ ID NO: 18 - DNA, 841 bp, Artificial Sequence
  full-length synthetic gene
  misc_feature (22)..(22): n is a, c, g, or t
  misc_feature (40)..(40): n is a, c, g, or t
gggggggggggggggtgacaanttcatcaacgaaacgatntcacccccaacgcccagtttttccaccgtcaacacacccagagaccatcacgacaatcggcaaaaatggcggacaacgactctcccgtcaccctccgaactcgcaagttcatccgcaaccctctgctgggccgtaagcagatggtcgttgacatcctccaccccaaccgtgccaacatctccaaggaggagctccgcgagaagctcggttccccctacaaggcccagaaggaccagatctccgtcttcggtctccgaacccagttcggtggtggcaagaccaccggcttcgctctcgtctatgactcccccgaggccatgaagaagttcgagcctcagtaccgattggtgcgcgttggcctcgccaccaaggccgagcgtgcttcccgacagcagcgcaaacaacgcaaaaaccgacaaaagactctccgaggtacggcaaaggtcaagggtgccaaggcgaagaaggagaaataaacgattcatggcttggcttgtgtatatcctcgggctggttggggagcggctgctgctatgtctgcagctgcgtgcattcggtggtcatgcgggtgcgtccatttactacggtccatcctcgtcgtcggcgtcggctttggcatagggtacagggacttgctggcggacgcgggggctatctggactcgacgaggggggttgaaggctacgctttcaccttccttgctcaatacactagcatgaaatcaatggtgtttttcgggtttcggaccaaaaacaaaaaatagcaatgtctctggttttcacgaaaaaaaaaaaaaaaaaa

SEQ ID NO: 19 - protein, 40 aa, Artificial Sequence
  synthetic peptide
VKVGLATKAERASRQQRKQRKNRQKTLMGTAKVKGAKAKK

SEQ ID NO: 20 - protein, 40 aa, Artificial Sequence
  synthetic peptide
VKVGLATKAERASRQQRKQRKNRQKTRRGTAKVKGAKAKK

SEQ ID NO: 21 - protein, 40 aa, Artificial Sequence
  synthetic peptide
VKVGLATKAERASRQQRKQRKNRQKTLRGTAQVKGAKAKK

SEQ ID NO: 22 - protein, 40 aa, Artificial Sequence
  synthetic peptide
VKVGLATKAERASRQQRKQRKNRQKTLRGTRKVKGAKAKK

SEQ ID NO: 23 - protein, 40 aa, Artificial Sequence
  synthetic peptide
VKVGLATKAERASRQQRKQRKNRQKTLMGTAQVKGAKAKK

SEQ ID NO: 24 - protein, 40 aa, Artificial Sequence
  synthetic peptide
VKVGLATKAERASRQQRKQRKNRQKTRRGTRKVKGAKAKK

SEQ ID NO: 25 - DNA, 69 bp, Artificial Sequence
  primer
ccaggatccttacttcttagccttagctcccttaaccttagcagttcccataagagtcttttgtctatt

SEQ ID NO: 26 - DNA, 72 bp, Artificial Sequence
  primer
ccaggatccttacttcttagccttagctcccttaaccttagcagttcctcttctagtcttttgtctattctt

SEQ ID NO: 27 - DNA, 58 bp, Artificial Sequence
  primer
ccaggatccttacttcttagccttagctcccttaacttgagcagttcctctaagagtc

SEQ ID NO: 28 - DNA, 60 bp, Artificial Sequence
  primer
ccaggatccttacttcttagccttagctcccttaacctttctagttcctctaagagtctt

SEQ ID NO: 29 - DNA, 69 bp, Artificial Sequence
  primer
ccaggatccttacttcttagccttagctcccttaacttgagcagttcccataagagtcttttgtctatt

SEQ ID NO: 30 - DNA, 72 bp, Artificial Sequence
  primer
ccaggatccttacttcttagccttagctcccttaacctttctagttcctcttctagtcttttgtctattctt

SEQ ID NO: 31 - protein, 52 aa, Brassica rapa
MAVPKKRTSISKKRIRKKIWKRKGYWTSLKAFSLGKSLSTGNSKSFFVQQNK

SEQ ID NO: 32 - protein, 37 aa, Pinus thubergii
MKIRASIRRISGKSRPIRRRKRVMIISSNPRHKQKQG

SEQ ID NO: 33 - protein, 44 aa, Spinacia oleracea
MNSHRLPGKGRRMGPIMGHTMHYRRMIITLQSSYSIPPLRKKRT

SEQ ID NO: 34 - protein, 50 aa, Saccharomyces cerevisiae
MAAQKSFRIKQKMAKAKKQNRPLPQWIRLRTNNTIRYNAKRRNWRRTKMN

SEQ ID NO: 35 - protein, 25 aa, Saccharomyces cerevisiae
MRAKWRKKRTRRLKRKRRKVRARSK

SEQ ID NO: 36 - DNA, 202 bp, Artificial Sequence
  BL36 synthetic gene
ggccatggagaagaagtctctcgccgggctctgcttcctcttcctcgtgctcttcgtggcccaagagatcgtggtgaccgaggccaagatccgcgcctctatccgccgcatctgcgggaagtgccgcccaatccgccgccgcaagcgcgtgatgatcatctgctctaacccacgccacaagcaaaagcaagggtgagaattc

SEQ ID NO: 37 - DNA, 114 bp, Artificial Sequence
  BL36 synthetic gene for cotton
atgaagattagagcttctattagaagaatttgtggaaagtgtaggccaattagaagaagaaagagagttatgattatttgttctaatccaagacataagcaaaagcaaggataa

SEQ ID NO: 38 - protein, 83 aa, Homo sapiens
MPLTKDLLHPSPEEKRKHKKKRLVQSPNSYFMDVKCPRCYKITTVFSHAQTVVLCVGCSTVLCQPIGGKARLTEGCSFRRKQH

SEQ ID NO: 39 - protein, 159 aa, Caenorhabditis elegans
MTSRLARLWQPGNPQRRVFLPDFWMAVVESPSVGRNRLPRNCVKFEVDPRMSRHDIREYLTKIYDLPVRDVRTEVQMGDITWNSKLDHQYKKAMWKDEDKKIAYVFMSKGFEFSYPQMFEALEEDLELVKAMKQQEELKDKLNERYANRNRRVGQFLGA

SEQ ID NO: 40 - protein, 149 aa, Caenorhabditis elegans
MFIPKSHTKLIYEYLFNEGVTVAKKDFNAKTHPNIEGVSNLEVIKTLKSLASRELVKEQFAWRHYYWYLTDAGILYLREYLALPAEIVPATIKTKPREIRVPHEDRAPRAAQGEKGDREAYRTEKVTEAGPGGAPVYRAGFGRGAPPPQ

SEQ ID NO: 41 - protein, 54 aa, Sulfolobus acidocaldarius
MGKYKPPAERRFGKGVQLCKRCGSRDSVMQKYGLYLCRQCFREVAYPMGFRKTR

SEQ ID NO: 42 - protein, 85 aa, Schizosaccharomyces pombe
MPGKYGVRYGASLRRDVRKIEVQQHSRYQCPFCGRLTVKRTAAGIWKCSGKGCSKTLAGGAWTVTTAAATSARSTIRRLREMVEV

SEQ ID NO: 43 - protein, 162 aa, Schizosaccharomyces pombe
MIRFAQYARYPVISRLMKPTVISPFQAQAFSSSSVMLKTLNQTIRNKEKRPEKTNKQSVALEGSPFRRGVCTRVFTVKPKKPNSAVRKVARVRLSTGRSVTAYIPGIGHNAQEHAVVLLRGGRAQDCPGVQYHVVRGVYDIAGVAGRVTSRSKYGVKKPKAA

SEQ ID NO: 44 - protein, 61 aa, Schizosaccharomyces pombe
MGKVHGSLARAGKVKSQTPKVEKQEKPKQPKGRAYKRLLYVRRFVNVTNMVGGKRRMNPSS

SEQ ID NO: 45 - protein, 104 aa, Schizosaccharomyces pombe
MEGFKRYVEVGRVVLVTKGEYTGKLAVIVDIVDHKRALIDSPCSEFPRQVIRYGSVVLTHIVMKLPRGAVPALSPRSGRLKMFATSGPLLLGPRNWKPRRFVAN

SEQ ID NO: 46 - protein, 56 aa, Entamoeba histolytica
MGSYSIYNAHPRNYGNGSRTCRKCGARKGLIRKYGLDLCRRCLREKAVEIGFQKLD

SEQ ID NO: 47 - protein, 146 aa, Caenorhabditis elegans
MTRATSIKDVDQHEATKSIAHFLKKSGKVKVPEWSDLVKLGVNKELAPVDPDWFYTRAASLARHLYFRPAGIGAFKKVYGGNKRRGVAPNHFQTSAGNCLRKAVQQLEKIKWVEKHPDGKGRILSKQGRKDLDRIATSLRSSGQQA

SEQ ID NO: 48 - protein, 100 aa, Cyanidium caldarium
MAHKKGSGSSKNGRDSNAKYLGIKKFGKQIVTPGQIIVRQRGTKIKPGLNVGLGRDYTIFSMIAGRVNYSTQKNKKIVSVDPSYGKIQAIEIRKASHFAT

SEQ ID NO: 49 - protein, 137 aa, Chlamydomonas reinhardtii
MRGLKSNKPKPRIQKVSVRKFRRKVLSLSQILSRLRQKRNQKIEQQKRNKPIKPLIPPKTLVIVLKEKPEKTLYNRRYIDYKHSGLLQRYIGLGGKILPRRQTRLTAKQQRFVAKTIKTARVMGLLPFVSKERSFFK

SEQ ID NO: 50 - protein, 144 aa, Dictyostelium discoideum
MKIPNRQKFTKNHKRNLITKETRKTGLVLGNYGIKATETGYLKMKQMERIKGDLVKKLKDNMDIYFNFYPLFGLTNKGTARMGAGKGEVSEWYVLVKKGSIVVEFIKSRMTAGAMQKVIRYSANKWPIKVRMTQIKQGLYEKKI

SEQ ID NO: 51 - protein, 129 aa, Dictyostelium discoideum
MIIKGSNFSVMDNSGARKVQCIQTLEGKKPTSLLRVGDKIVVVIKKMEKRKGGKYKLKVKKSDVCYAVIVKSKQPVRRKSGIIVNAGENGVILLTKTKEPIGTRLTGVVFKEVQRTGLLKNVSISKYII

SEQ ID NO: 52 - protein, 101 aa, Dictyostelium discoideum
MKIIRKNKKDKERREIYKQAEKMKNMYKMLRRNELLDQETRNYFNMKVTSSEKNSSISRIKNRCVETGRSRGIISAYRISRLRFREYMKMGLISGVKKISY

SEQ ID NO: 53 - protein, 152 aa, Dictyostelium discoideum
MKKLQNVFAAIKTGLLAKATSVTVIGSKRVFEILSRFENEGLIRGFQIIDISKNKVSIYLKYKQDMTSLLSKIKVVSVNKEKLYIKGKLLKKLNTGVNMYFVESKFGLQTLPQLKIRNKRLYAPLGGEIKYIVEINKVNPKIQELIKKKHEI

SEQ ID NO: 54 - protein, 169 aa, Dictyostelium discoideum
MGIVIGKIELNNEKQIIGELKKKIKGVNFHIAQKVIMLSGNVASIKGNKLIQSEEKQIVDILQRFKGLYSHNYGLKEEALAKIRRIENVYRYIRVRQGYPVRGRTKSNANTVKRQRNVSTGVKTKRKKMYLLNGKPTNRKERKIFNKLKKLQEKKNKEQKKSQKCKTKK

SEQ ID NO: 55 - protein, 145 aa, Reclinomonas americana
MNKIIGFIRLEIESGKASPSPPVGPALGLRGVNIMQFCKEFNNRCKQLNIKDGVPVPTIITVYDDKTFSFKMKTPSITYFIKKHLEISKGASKPGKENFLNIDIRSLYEIAEIKKIDSNLDIKSICKSLIGSVKSMGIKTIIVKN

SEQ ID NO: 56 - protein, 131 aa, Reclinomonas americana
MPTINQLLKINKKRKADKNERRKFSKAPALESCPQKKGVCTRVFIASPKKPNSAKRKVARVRLTNGQEVTAYIPGEGHSLQEHSVVLIRGGRVKDLPGVKYHIVRGTFDLQGVQNRRQGRSLYGTKKQKDL

SEQ ID NO: 57 - protein, 116 aa, Reclinomonas americana
MFITKCSLHLKSFDLDVLKDSCALILKNKINLQNLKLTGPINLPTKIKKITVLRSPHIDKKSREQFEIRTYTKTIQIESLTKNTNDIINFMKQFENSFFFGLNIKVVFTYKKDVLL

SEQ ID NO: 58 - protein, 86 aa, Reclinomonas americana
MTRSIWKGPHVDSSLLSKLNKIRKTDSKKKINTWSRRSVILPQFIGLSFNIYNGNKWVSVTVTEDMIGHKLGEFSLTRKAVKHKKK

SEQ ID NO: 59 - protein, 137 aa, Reclinomonas americana
MVRPKRTKYRKCQKGRVGGVDPRSDVHFGSYGLKALEPCRITEKQVEACRVAITRKIKRIGKVWIRIFPDIPVSSKPTEVRMGKGKGSVDYWMCRVKAGKIMFEIDGVSMELAKRALELGASKLPVPTIFVMKKKYI

SEQ ID NO: 60 - protein, 100 aa, Reclinomonas americana
MISHFSIKDKKRRFLYLKYEWKRLQLKAIAENMLLPMDIRFKARLEINELPKDSSKVRIRNRCIITGRPRGVHKYWRLSRIKIRELMAQNKIPGLRKSSW

SEQ ID NO: 61 - protein, 128 aa, Reclinomonas americana
MTQIQSIQSLMSNIKQGQKNNLLSVDIIYSKLNFDILNVLYEEGYIRDFEKKTNKKNQDIINVRLKYYNNTSAIKNIQRVINQHISLKLLNQIDLGLVTYILSTSKGIFSGKEAKRLNLGGTVLLIIW

SEQ ID NO: 62 - protein, 122 aa, Reclinomonas americana
MIHLFGININSNKKIPFALKAIYGLGNKKVDELCSYMGLNPKLKMSDLNESQISKLCHYIEENFLIESELRKNQTYNIKRLLDIKSYRGLRHAYGLPVHGQRTHTNAKTQKSLSKRRNIKAL

SEQ ID NO: 63 - protein, 129 aa, Reclinomonas americana
MIKELKKDSKKDNNNIFYGHVHVKASFTNTIVTITDCMGNTISWASSGSSGFKGARRSTSYAAQAAAENAGKKAIEHGIRSVKLITRGLGPGRLSCTKGLLSAGLKISLVGDLTPIPHNGCRAKKKRRV

SEQ ID NO: 64 - protein, 115 aa, Reclinomonas americana
MIRVKSGTTTHSRHKKIIKNATGYRGRSKNCFSIAIEKVHKGLQYAYAHRKVNKRFFRNVWIQRINAACTTSQINYSSFIHNLSLQNIQLNRKILSTLAITEPYTFQSILKTINT

SEQ ID NO: 65 - protein, 81 aa, Reclinomonas americana
MATKKSGGSSRNGRDSKGRRLGVKLFGGEYATIGSIIVRQRGTKILPYKNVGLGRDHTIFALKEGIVSYYKDKTKTYVSIV

SEQ ID NO: 66 - protein, 42 aa, Reclinomonas americana
MKRTFQPSTLVKKRKHGFLNRNKTKNGKALLKRRFLKGRKVI

SEQ ID NO: 67 - protein, 71 aa, Reclinomonas americana
MKKGIHPLKRSLDVIMTNGSFVKTIIVSSYIKKNLKLDIDTNKHPCWNPHKKVFVLDSSNLLQKFKSKYQI

SEQ ID NO: 68 - protein, 159 aa, Arabidopsis thaliana
MRLEKCWFCSSTIYPGHGIQFVRNDAKIFRFCRSKCHKNFKMKRNPRKVKWTKAFRAAHGKDMTKDTTFEFEKKRNRPERYDRNVTENTLMAIKKIAKIRTAREAKHIENRLKPNKQKKLNDDMKELDQNIHMVQAPGAQKIKVDVSEKKSVQNEAMEE

SEQ ID NO: 69 - protein, 133 aa, Arabidopsis thaliana
MTFKRRNGGRNKHNRGHVNPIRCSNCGKCCPKDKAIKRFIVRNIVEQAAIRDVQEASVYEGYTLPKLYAKTQYCVSCAIHSHVVRVRSRTNRRVRTPPPRFARRKEDTPKPGQPGQAPRPAGPGAAAAAAPRV

SEQ ID NO: 70 - protein, 179 aa, Arabidopsis thaliana
MRNLRIISSHFSRVLKSTETRSSSVQLFTIQSRSYSSPATQSENVSKIVNELSNLTLLETMDLTEILRQKLNISELPVMAAMMPGMSLPGSGASKSAGGEGKEKKKEAKTAFDVMLQAYDAVSKIKVIKEVRTITALGLKEAKDLVEKAPTLLKKGVSKEEAEKIIEKLKAVGAKVAME

SEQ ID NO: 71 - protein, 101 aa, Arabidopsis thaliana
MEALRRIMKRLTRRLKMLKRLLKKFCWNKKIDKLVYYHDMFMKVKGKVYKNKCVLMESMHKSSRERKFSGSEMRLALVTIKSCFIKICSEPEGEKTASAPQ

SEQ ID NO: 72 - protein, 125 aa, Brassica napus
MPTFNQLIRHGREEKRRTDRTRALDKCPQKLGACPRVSTRTPKKPNSALRKIAKVRLSNRHDIFAHIPGEGHNSQEHSAGVVRGGRVKDSPGVKSHGIRGVKDLMGIPGEIIGRSKYGAEKPKSI

SEQ ID NO: 73 - protein, 154 aa, Nicotiana plumbaginifolia
HTAGRYQAKRFRKAQCPIVERLTNSLMMHGRNNGKKLMAVRIVKHAMEIIHLLTDLNPIQVIVDAVINSGPREDATRIGSAGVVRRQAVDISPLRRVSQAIYLLTTGARESAFRNIKTIAECLADELINAAKGSSNSYAIKKKDEIERVAKANR

SEQ ID NO: 74 - protein, 102 aa, Nicotiana plumbaginifolia
MKPVVGTVVSNKRQKSVVVAVDRLFHNKLYNRYVKRTSKFMAHDQNDECNIGDRVKLDHSRPLSKRKHWVVSEILKRSIMDVPPPKSSSEIDSKTGVSADAN

SEQ ID NO: 75 - protein, 105 aa, Synechococcus sp
MLARISELTKIGTTIFIVAIDQVAEPNSWGSSQLVLLAKIAGALKAIPPNPVCTSRHRQAASVSPFRSAIVGTLLQLEAIKNLLTVSVDTIQQNGVLFIFVALLR

SEQ ID NO: 76 - protein, 123 aa, Halobacterium halobium
MTTITPESLPRHELLGLHARVAADTDQSRVGIAGRVVDETMQTVVLRTASGVAQVPKKGATFEFRLTDEAAAPDNGVGTAFKPAGGETRQTTGESVAYVTVDGGRLLSRPERRSENGVDSKWR

SEQ ID NO: 77 - protein, 171 aa, Methanobacterium thermoautotrophicum
MGHPRKARKKYDTPPHPWNAERIKEENRLVAKYGLKNKKEVWKAETMVRRYRRDARYLLGMASEHTGKEREQLLGHLVRTGILNEGAKLEDVLDLTVEDVLRRRLQTLVHKRGLARTVKEARQMVIHGHIALDGRKIDAPGYIVKRGEEDKIGFYPSSPMKKQIEAAQDAE

SEQ ID NO: 78 - protein, 62 aa, Methanobacterium thermoautotrophicum
MGNIRTSFVKRIAKEMIETHPGKFTDDFDTNKKLVEEFSTVSTKHLRNKIAGYITRIISQQK

SEQ ID NO: 79 - protein, 63 aa, Methanobacterium thermoautotrophicum
MIGVIFYNTKGNFLRVKCLDCGNQQVVFDRAASYVQCIICGKTLVEPTGGKSKIKAQILEVLD

SEQ ID NO: 80 - protein, 134 aa, Methanobacterium thermoautotrophicum
MMSLKPDWVEYSNEEIEDLIVKLYREGNSTSKIGIILRDQHGIPSVKAVTGLKITQILEKHEMKPEYPEDLMNLIRKAVNIRDHLKEHPKDLHTRRGLQIVESKIRRLVRYYVREGVLPEGWRYDPQKAALLVK

SEQ ID NO: 81 - protein, 146 aa, Archaeoglobus fulgidus
MTFKHIVRIADTDLDGNKSLMFALTGIKGIGLRAARCIVNELGVDGRAKLGELDDETIEKVKKFVEEEIESLPSWLLNRRKDPYSGQDLHLLSKDVDFARMLDIERLIKMKAYRGVRHARGKKVRGQRTRSTGRKGRTVGVVRRKR

SEQ ID NO: 82 - protein, 133 aa, Archaeoglobus fulgidus
MAEKKKGGRWGIAHIYSSYNNTIITITDITGAEIIARVSGGMIVKADRDEGNPYTAMQAALRAAAIAKEKGIDGVHIKVRAPGGNKHTTPGPGAQAAIRALARAGLKIGRIEDVTPIPHDGTRPPGGKRGRRV

SEQ ID NO: 83 - protein, 147 aa, Archaeoglobus fulgidus
MATVYDVPADLLIKRVAERLKDMVAPPEWAKYVKTGVHKERSPEQDDWWYLRLASIFRRVYIDGPVGIERLRTFYGGRKRRGSKPPKFRKGSGAIVRNALHQLEQLGFVKKTREGRVVTPMGRSFLDKVATELKSELVSEIPALEKY

SEQ ID NO: 84 - protein, 57 aa, Archaeoglobus fulgidus
MKFEVRGAFKTLEGWQKFTKVVEANNERYALEKVYSLIGSNHKVKRNLIKIEEVKQA

SEQ ID NO: 85 - protein, 133 aa, Archaeoglobus fulgidus
MALKSKVIRPRDFKYRGYTLEELQKMPLEELAKLLPARERRKIKRGFTEQEEKLLRKLRKKGTARTHCRDMVVLPEMVGKVVFVHNGKEFVRVEIKPEMIGHRLGEFALTRRFEKHSGPGVGATRSSKYVPLK

SEQ ID NO: 86 - protein, 111 aa, Archaeoglobus fulgidus
MRDIGIDVKPPERECEDENCPFHGTLSVRGQLLRGKVVKVYGKTAVIERELIRYVPKFERYMKKRSKLHAHNPRCIRARPGDIVTIGECRPISKTKSFVILEVVGNEGNKS

SEQ ID NO: 87 - protein, 51 aa, Archaeoglobus fulgidus
MKKERTKVFGRGANECRRCGRRRGLIRMYGLYLCRQCFREVASELGFKKYW

SEQ ID NO: 88 - protein, 144 aa, Archaeoglobus fulgidus
MDMGRGLFAARKLMENRKKFRWSDRRFVRRTLGLAAKADPLEGAPMARGIVLEKIGIEARQPNSAIRKAVRVQLIKNGRQITAFCPGDGAINFIDEHDEVIVEKIGGRMGRSMGDIPGVRYKVVKVNNTSLRELVRGRKEKRLR

SEQ ID NO: 89 - protein, 55 aa, Archaeoglobus fulgidus
MAKGAESIYRYYEIKGEKVVRKKKFCPRCGEGVFLAEHKDRLSCGKCGYTEFKKK

SEQ ID NO: 90 - protein, 106 aa, Archaeoglobus fulgidus
MPIKGPKARIKLSGLNPRELDRICSQIKEIANKTGVELSGPVPLPTRRMVVPVRKAPDGEGSETWDHWEMRVHKRLIDISADERALRQIMRIQVPRDVNIEIVLES

SEQ ID NO: 91 - protein, 65 aa, Archaeoglobus fulgidus
MGTVKPAYIKVIARELLKKYPEVFTGNFDENKRLVAELTNIQSKTVRNRVAGYITRRVNRGLVNV

SEQ ID NO: 92 - protein, 152 aa, Archaeoglobus fulgidus
MARIHARRRGKSGSKRIYRDSPPEWVDMSPEEVEKKVLELYNEGYEPSMIGMILRDRYGIPSVKQVTGKKIQKILKEHGVEIKYPEDLKALIKKALKLRAHLEVHRKDKHNRRGLQLIEAKIWRLSSYYKEKGVLPADWKYNPDRLKIEISK

SEQ ID NO: 93 - protein, 71 aa, Archaeoglobus fulgidus
MADEEDIQPAEVVELVGRTGMHGEVTQVKVRVLAGENKGRVITRNVFGPVKVGDIIMIKETAREARKLAVR

SEQ ID NO: 94 - protein, 150 aa, Archaeoglobus fulgidus
MSRFFAVKTTANQERVVANLMDMAARKHNLKVYSILAPKELKGYIIVEAETPDDLLKAIRGLPHVKGVVKGEISFSEIEHFLTPKKAAEQIREGDKVEIVSGPFKGEMAIVKRVDEAKNEITVELLEAVVPIPVTVKADHVRVIDKKEEV

SEQ ID NO: 95 - protein, 129 aa, Archaeoglobus fulgidus
MEFRVVISDPKTGRAYQKVVEGANANRLIGKQIGDVISGTIVDLPPDYELKITGGTDRDGFPMRPDLPGTARRRLLLSGGVGFRPKEKGLRKRKGVRGRVISKDILQINTVVVKHGKVPLEEIFKQKEE

SEQ ID NO: 96 - protein, 140 aa, Streptomyces griseus
MPPKKKKVTGLIKLQINAGAANPAPPVGQHGVNIMEFCKAYNAATESQRGMVVPVEITVYEDRSFTFVTKTPPAAKLILKAAGVDKGSGEPHKTKVAKLTAAQVREIATTKLPDLNANDLDAASKIIAGTARSMGITVEG

SEQ ID NO: 97 - protein, 146 aa, Mus musculus
MARNVLYPLYQLGGPQLRVFRTNFFIQLVRPGTAQPEDTVQFRIPMEMTRVDLRNYLEQIYNVPVAAVRTRVQHGSNRRRDHKNVRIKKPDYKVAYVQLAHGQTFTFPDLFPEKDPRSPEPLEEELPQQRQSSDLRCPGIPSWFGL

SEQ ID NO: 98 - protein, 89 aa, Schizosaccharomyces pombe
MTKGTQSFGMRHNKSHTICRRCGKRSFHIQKSTCACCGYPAAKTRSYNWGAKAKRRRTTGTGRMSYLKKVHRSFKNGFRAGKPTSAATA

SEQ ID NO: 99 - protein, 101 aa, Schizosaccharomyces pombe
MRALGHLKHKAFRDLLCRRLFAEHEVERQSNLYIYRNPELPLRVRLEAKKRIEALPTNAHPTKIKNRCIETGRGRGVFRAFGLARFPFRLKALANKLPGVR

SEQ ID NO: 100 - protein, 125 aa, Lupinus albus
MTTLNQLIRHGREEKRRTDRTRASDQCPQKQGVRPRLSTRTPKKPNSAPRKIAKVRLSNRHEIFAHIPGEGHNSQEHSMVLIRGGRVKDLPGVKSHCIRGVKDLLGIPDRRRGRSKYGAEKPKSR

SEQ ID NO: 101 - protein, 89 aa, Phytomonas serpens
MFFVRSYCLYGFCVRFCFVFLCIYVSPRLPSSGNRRVYVVCFNLYSFVIYCFLFGCCVICYSQSFYFLCEGGGFVDLPCIKLYVRVPIA

SEQ ID NO: 102 - protein, 125 aa, Lupinus angustifolius
MPTFNQLIRHGREEKRRTDRTRASDQCPQKQGVRPRLSTRTPKKPNSAPRKIAKVRLSNRHEIFAHIPGEGHNSQEHSMVLIRGGRVKDLPGVKSHCIRGVKDLLGIPDRRRGRSKYGAEKPKSR

SEQ ID NO: 103 - protein, 154 aa, Arabidopsis thaliana
MSPAKVDTTKKADPKAKALKAAKAVKSGQAFKKKDKKIRTKVTFHRPKTLTKPRTGKYPKISATPRNKLDHYQILKYPLTTESAMKKIEDNNTLVFIVDIRADKKKIKDAVKKMYDIQTKKVNTLIRPDGTKKAYMRLTPDYDALDVANKIGII

SEQ ID NO: 104 - protein, 63 aa, Selenomonas ruminantium
MASVCEICAKGELSGNNVSHSHLKTRRTWKPNIQRVRAVVEGEVKRVNVCTRCLRSGKVQRAL

SEQ ID NO: 105 - protein, 96 aa, Borrelia burgdorferi
MYKDRDTNQRDSRFENQQDGFKKNSNFRFFKRKSCKFCDSGKHPDYKDFDFLKKFITEQGKILPKRITGTSAKHQRRLALEIKRARYMALLPFVKK

SEQ ID NO: 106 - protein, 101 aa, Borrelia burgdorferi
MIKRKLRLQLKKARFNASRSRSKNKCFIKRMENNRKIISKNNINVQVFLVRSLIGKLNKKVKVLKALGLNKIGDKKVHFLNESIKGMLNETINMILLSEVM

SEQ ID NO: 107 - protein, 134 aa, Borrelia burgdorferi
MEGKLSAKLSTNSKKKIKRNIGEGNVYIQATFNNTIVTVSDIKGNALAWASAGGMGFKGAKKSTPYAAQITAESALNKVRDFGINYVHVYIKGPGIGRESAIRAIGSIGMTVKSISDITPIPHNGCRPKKTRRV

SEQ ID NO: 108 - protein, 71 aa, Pseudomonas putida
MPAVKVKENEPFDVALRRFKRSCEKAGVLAEVRSREFYEKPTAERKRKAAAAVKRHAKKVQREQRRAVRLY

SEQ ID NO: 109 - protein, 121 aa, Mycoplasma gallisepticum
MTEQKAKSSKTSSEEAKKQKELTEIKIKLKSYDSRLLDQSVKKIFEIVKETGSKFCGPIPLPTKKEVFTIIRSPHVDKASREQFERRTHKRLIIIKNLKNETIQKLKRFVIPSCVELRIYL

SEQ ID NO: 110 - protein, 87 aa, Mycoplasma gallisepticum
MSRSSKKGAFVEASLYKKVLDMNAQQKKKIIKTWSRRSTIFPDFVGHTFAVHNGKKFINVYVTEDMIGHKLGEFSPTRTFKGHSSNR

SEQ ID NO: 111 - protein, 85 aa, Mycoplasma gallisepticum
MRNSRKVLMGVVVSDKMQKTATVKVESKNRHPFYHKLVISHKKYHVHNEEGENAAKVGDKVLIMETRPLSATKRWRIAKIIERAK

SEQ ID NO: 112 - protein, 61 aa, Mycoplasma gallisepticum
MAKTSLKIKQARHAKFKVRAYTRCKRCGRPHAVYRKFGICRLCFRHLAYNGSLPGVKKSSW

SEQ ID NO: 113 - protein, 84 aa, Mycobacterium leprae
MAKSTKRRPAPEKPAKARKCVFCAKKNQQIDYKDTTLLRTYISERGKIRARRVTGNCVQHQRDIAIAVKNAREVALLPFTSSAR

SEQ ID NO: 114 - protein, 121 aa, Rattus norvegicus
MADDAGAAGGPGGPGGPGLGGRGGFRGGKAEDKEWIPVTKLGRLVKDMKIKSLEEIYLFSLPIKESEIIDFFLGASLKDEVLKIMPVQKQTRAGQRTRFKAFVAIGDYNGHVGLVLSAPRR

SEQ ID NO: 115 - protein, 158 aa, Pyrococcus horikoshii
MARMHARKRGKSGSKRPPRTAPPIWLDYTVEDIENLVVKLRKEGYSTAMIGTILRDQYGIPTVKLFRDPDNPNRKLTITRILEKHGLAPEIPEDLMFLIRRAVNLRKHLEQHPKDLHSMRGLQLIESKIRRLVKYYKRKGKLPRDWRYDPEQAKLLVR

SEQ ID NO: 116 - protein, 125 aa, Pyrococcus horikoshii
MTTFKLVISDPKSGIAKQIEISGANAEKLIGKKIGDQIPVKELGLDLKALFGKDFPEDVKMEIRGGTDKDGFPMRPDIHGPRRVRILLSKGPGFRPKEKGERRKKTVRGNTISPEIVQVNVKLVY

SEQ ID NO: 117 - protein, 127 aa, Pyrococcus horikoshii
MAIWQGRSLKKPSGGRIVLARKKRKRELGREPSNTRVAEQDKRKIIRTYGGNRKVRLTAAAYANVFDKSGKGRKVRIIRVLENPANRQFARRNIITKGAIIETEIGKAKVTSRPGQDGVVNAILLEE

SEQ ID NO: 118 - protein, 150 aa, Pyrococcus horikoshii
MATVYDVPGDLLVERVAQRLKEIPEIKPPEWAPFVKTGRHKERLPEQEDWWYYRVASILRRVYIDGPVGIERLRTYYGGRKNRGHAPERFYKAGGSIIRKALQQLEAAGFIEKVPGKGRVVTPKGRSFLDKIATELKKELEEIIPELKKY

SEQ ID NO: 119 - protein, 102 aa, Pyrococcus horikoshii
MQKARIKLASTNVRSLEEVANQIRQIAERTGVRMSGPIPLPTKRIRIVTRKSPDGEGSATFDRWELRIHKRLIDIEADERAMRQIMRIRVPEDVTIEIELIS

SEQ ID NO: 120 - protein, 150 aa, Pyrococcus horikoshii
MMLMPGKKAPNGEFAGRKLKLKRKKFRWSDIRYKRRVLRLKEKSDPLEGAPQARGIVLEKIAVEAKQPNSGMRKAVRVQLIKNGKVVTAFCPGDGAINFIDEHDEVIIEGIGGPKGGSMGDIPGIRYKVVKVNRVSLKELVKGRKEKPRR

SEQ ID NO: 121 - protein, 135 aa, Pyrococcus horikoshii
MRIIQTTGKRKTAIARAVIREGRGRVRINGKPVEIIEPEIARFTILEPLILAGEEIWNSVDIDVKVQGGGFMGQAEAARIAIARALVEWTGDMNLKEKFIKYDRTMLVGDPRRTEPHKPNRSTKGPRAKRQKSYR

SEQ ID NO: 122 - protein, 137 aa, Pyrococcus horikoshii
MSEEQVNIKKKEKWGIAHIYSSYNNTIIHITDITGAETISRWSGGMVVKADRDEPSPYAAMLAARRAAEEALEKGIVGVHIRVRAPGGSKSKTPGPGAQAAIRALARAGLKIGRVEDVTPIPHDGTRPKGGRRGRRV

SEQ ID NO: 123 - protein, 132 aa, Pyrococcus horikoshii
MARKEFRYRGYTLEQLMNMSLEELARLLPARQRRSLRRGLTPEQKKLLRKIRLAKKGKYNKPIRTHCRDMIILPEMVGLTIYVHNGKEFVPVEIKPEMIGHYLGEFAPTRKRVQHGAPGIGATRSSMFVAVK

SEQ ID NO: 124 - protein, 116 aa, Pyrococcus horikoshii
MEKMVRDIGLRIQPPAEKCDDPKCPWHGHLKIHGRVFEGIVISDKPRKTVTVERQYYHYLKKYERYELRRSRIHAHNPPCINAKVGDRVLIAETRPLSKTKHFVVVAVLERAEERR

SEQ ID NO: 125 - protein, 130 aa, Pyrococcus horikoshii
MTLLDPLANALSHITNSERVGKREIYIKPASKLIGEVLRVMQKYGYIGEFEFIDDGRAGVYRVQLLGRINKAGAIKPRFPVKATEYEKWEKRFLPAFEFGILIVSTSQGVMSHKEARDRGIGGRLIAYVY

SEQ ID NO: 126 - protein, 109 aa, Pyrococcus horikoshii
MSEREPTGPGEEVKEMKYPKQIRTYCPYCKRHTIHKVERVKRRPRSELSAGQRRFRRVLKGYGGFPRPKPEGREKPVKKLDLRFVCTVCGRAHTRGKGFRVKRFELVEV

SEQ ID NO: 127 - protein, 151 aa, Schizosaccharomyces pombe
MVYILGVAVNDDKPVRFALLSFYGIGHAKAEEICAKLSFHNTLRVRELTNVQLTTLSQLLSGMTIEGDLRRQRNADISRLVNIRCYRGMRHVNGLPVNGQNTRTNAKTAKKLNKVPRRGYMTLSPASTRPITWSFCLPRMVSVFQKLKHIH

SEQ ID NO: 128 - protein, 157 aa, Schizosaccharomyces pombe
MSTLNGQTALAYAKVWHHVSAKNVPLGRLASQIATTLMGKHKPIYHPAADCGDVVVVTDCSEIGISGRKLENHKYYSHSGQPGHLKEWTMEEMAAKRGHKDLLRRAVGGMLPRNKLWDRRMKRLYIYDGAEHPYKANIFRSYHNPVSSQIAKELFSK

SEQ ID NO: 129 - protein, 128 aa, Homo sapiens
MAAFMLGSLLRTFKQMVPSSASGQVRSHYVDWRMWRDVKRRKMAYEYADERLRINSLRKNTILPKILQDVADEEIAALPRDSCPVRIRNRCVMTSRPRGVKRRWRLSRIVFRHLADHGQLSGIQRATW

SEQ ID NO: 130 - protein, 105 aa, Homo sapiens
MVNVPKTRRTFCKKCGKRQPHKVTQYKKVAMVPAQGKRCYDRKQSGYGGQTKPIFWKKAKTTKKIVLRLECVEPNCRSKRTLAIKRCKHFELGGDKKRKGQVIQF

SEQ ID NO: 131 - protein, 165 aa, Homo sapiens
MPPKFDPNEIKVVYLRCTRGEVGATSALAPKIGPLGLSPKKVGDDIAKATGDWKGLRITVKLTIENRQAQIEVVPSASAPIIKALKKPPRDRKKQKNIKHNGNITFDEIVNIARQMRHRSLARELSGTIKEIPGTAQSMGCNVDGHHPHDIIDDINSGAVECPAS

SEQ ID NO: 132 - protein, 92 aa, Caenorhabditis elegans
MTKGTQAFGKKHVKSHTLCKRCGKSSFHIQKKRCASCGYPDAKKRTYNWGAKSIRRRTTGTGRTRHLRDVNARFRNGFREGTTPKPRAQPTN

SEQ ID NO: 133 - protein, 147 aa, Encephalitozoon cuniculi
MTDRVKKTRKLRGHVSHGYGRVGKHRKHSGGRGLAGGFSHMKTFFTRFHPDYHGKRGMRVYHRKENSDYARPISSARLWGMIPKEQRYDFLDNPEKVPVIDVREFGYHVVVGGKLSLERPIVVKARYFTPSAKEEITKVGGKWIITY

SEQ ID NO: 134 - protein, 155 aa, Lathraea clandestina
MSRRGTAEEKTAKSDPIYRNRLVNMLVNRILKHGKKALAYQIIYRAMKKIQQKTETNPLSVLRQAIRGVTPDIAVKARRVGGSTHQVPIEIGSTQGKALAIRWLLAASRKRPGRDMAFKLSSELVDAAKGSGDAIRKKEETHKMAEANRAFAHFR

SEQ ID NO: 135 - protein, 148 aa, Beta vulgaris
MGGLDSEQKQLIKKLVNFHMKEGKRTKVRAIVYQTFHRLARTEGDVIKLMIDAVENIKPICKVEKVRVAGTIYDVPGIVARDRQQTLAIRWILEAAFKRRISYRISLEKCLFDEILDAYRKRGISRKKRENLHGLASANRSFAHFRWW

SEQ ID NO: 136 - protein, 84 aa, Arabidopsis thaliana
MVLQNDIDLLNPPAELEKRKHKLKRLVQSPNSFFMDVKCQGCFNITTVFSHSQTVVMCGNCQTLLCTPTGGKAKLTEGCSFRKK

SEQ ID NO: 137 - protein, 136 aa, Arabidopsis thaliana
MLSRSVVKHANNLGQIQARHFTTTLMKSGPKHSGTEQGVKRNSADHRRRLLAARFELRRKLYKAFCKDPDLPSEMRDKNRYKLSKLPRNSAFARIRNRCVFTGRSRSVTELFRVSRIVFRGLASKGALMGITKSSW

SEQ ID NO: 138 - protein, 151 aa, Picea mariana
MADADVDVGPVQPKKRTFKKFSYRGVDLDALLDMTSEELVKLFHARARRRFQRGLKRQPMALIKKLRKAKREAPSGEKPEPVRTHLRNMIIVPEMIGSIIGVYNGKTFNQVEIKPEMIGHYLAEFSISYKPVKHGRPGIGATHSSRFIPLK

SEQ ID NO: 139 - protein, 155 aa, Arabidopsis thaliana
MAEQTEKAFLKQPKVFLSSKKSGKGKRPGKGGNRFWKNIGLGFKTPREAIEGTYIDQKCPFTGTVSIRGRILSGTCHSAKMQRTIIVRRDYLHFVKKYRRHSNIPAHVSPCFRVKEGDRVTIGQCRPLSKTVRFNVLKVIPAGSSSIGKKAFTGM

SEQ ID NO: 140 - protein, 113 aa, Arabidopsis thaliana
MTVKIRLARLGCKHRPFYRVVVADEKSRRDGKQIEVLGFYDPLQGKEDADRVSLKFDRIKYWLSVGAQPTDTVESMLFRAGLIPPKPMVVVGSKNGQKSTSQHVSPITGEILN

SEQ ID NO: 141 - protein, 94 aa, Pisum sativum
MAERRRTNHRVSRFNYWLRIHASVQINVGHLDESGVYNGHFSTFALCGFTRAQEMLTVELTACGRKKKLNLSIDDMITSCCVLLTDLCVSSTFP

SEQ ID NO: 142 - protein, 131 aa, Phytoplasma sp. strawb1
METETKQAKAIASKVSIAPRKVRLVIDLIRGKNIAQAQAILTFTSKVAAPVILKLLNSAVANATNNLKLNHEQLYVKEVFVNEGLRLKRIFPRAKGSGDMIKKRTSHITLVVALKNKQILKEAQDGSENQS

SEQ ID NO: 143 - protein, 129 aa, Phytoplasma sp. strawb2
METKNAKAIARKVSIAPRKARLVVDLIRGKNIAQAQAILTFTPKVAAPVILKLLNSAISNAVNNLKLNREQLYVKEVFVNEGLRLKRMFPRAKGSGDMIKKRTSHITLVITSSTNLQTSKEEEQSGSKN

SEQ ID NO: 144 - protein, 104 aa, Aquifex aeolicus
MEQEKIRIKLRAYDHRLLDQSVKQIIETVKRTGGVVKGPIPLPTRKRKWCVLRSPHKFDQSREHFEIREFSRILDIIRFTPQTIEALMEISLPAGVDVEVKMRG

SEQ ID NO: 145 - protein, 110 aa, Aquifex aeolicus
MRHYKTLRYYETVFAVKPTLSEEEMKKKFEQVKEFIKQKGGEILYEEDWGMRQLAYPIQKFNNARYFLVQFKTENPQLPNELDFQLKIDEDVIRWLNFQIKESEVKKNAQ

SEQ ID NO: 146 - protein, 72 aa, Aquifex aeolicus
MVVRAPKKKVCMYCEQKREPDYKNYEELRNFLTERGRIKDRKQTGLCAKHQRRLAVQIKRARQLGLLPYVVY

SEQ ID NO: 147 - protein, 118 aa, Aquifex aeolicus
MRHRVKKKHFDRTKEQRLALYRSLARALIFDERIETTVERAKALRSFIEPLVELAKEGTLHARRQALSRLPDKPAIKKLFEDIAPRFEGRNGGYVRIIKLPYRRRGDGAEMAIIEWVE

SEQ ID NO: 148 - protein, 125 aa, Aquifex aeolicus
MAKKKKKQKRQVTKAIVHIHTTFNNTIVNVTDTQGNTIAWASGGTVGFKGTRKSTPYAAQLAAQKAMKEAKEHGVQEVEIWVKGPGAGRESAVRAVFASGVKVTAIRDVTPIPHNGCRPPARRRV

SEQ ID NO: 149 - protein, 126 aa, Aquifex aeolicus
MARIAGVDLPNNKRLEVALTYIYGIGWSRAREICEKTGIPCTKRVGELTPDELNTLRKFIDENYKVEGDLRREVQLNIKKLKDMGCYRGIRHARGLPVRGQQTRTNARTRKGKRKTVGGTKKAKAK

SEQ ID NO: 150 - protein, 49 aa, Aquifex aeolicus
MKVRSSVKKRCAKCKIIRRKGRVMVICEIPSHKQKTGVTEVRNGENSGR

SEQ ID NO: 151 - protein, 69 aa, Aquifex aeolicus
MADSEICGKRPVVGRRVTLSGERNRRIFKPNVHKMRVMLPDGTVKRMYVCTKCLKAGKVMKAPRIPKEG

SEQ ID NO: 152 - protein, 112 aa, Aquifex aeolicus
MAVRIRLAKFGRKHHPIYRIVVMDAKSPREGKYIDILGTYDPKRKVLINVYPEKVKEWVLKGVELSHRAKAILWNHGILKEVVPEGYEMKRVGDYYVFEKRESKKSKGGEAA

SEQ ID NO: 153 - protein, 47 aa, Aquifex aeolicus
MVTEGLKPHISIKKKKRKSGFLARMRTKSGRKIIARRRRKGRKRLAP

SEQ ID NO: 154 - protein, 90 aa, Aquifex aeolicus
MVLPKDVKWDLIRQFQRHEQDTGSPEVQIAILTERINRLTEHMKKHKKDIHSRRGLIAMVNKRRKLLEYLRETDYAKYLEVVQKLNLKVK

SEQ ID NO: 155 - protein, 160 aa, Aquifex aeolicus
MPRKGPVPPREIPPDPKYGDVLVQKLINKVMKDGKKSVAEWIVYTALEEAAKEVNMHPVELLHKVIEKLKPEWEVRPRRVGGATYQVPIEVPERRQISLAIKWLVQAARERPRGRGQYTMIERLKAELLDALNERGGAYKKKEETHRMAHANMVFSHFRW

SEQ ID NO: 156 - protein, 67 aa, Aquifex aeolicus
MAKVKMKTNRSAAKRFKVTAKGKIKRWKSGGAHYNTKKSSKRKRHLRKHTYVKDNMLKHVKALLKEF

SEQ ID NO: 157 - protein, 67 aa, Aquifex aeolicus
MVTVIVQEGEPIEKVLKRFKARVEQEQILTELKRREYYEPPSERKKKRERNRRKKILKALKKQQQLI

SEQ ID NO: 158 - protein, 118 aa, Aquifex aeolicus
MRVKGPSSRRKKKKILKLAKGYRGQRSRSYRRAKEAVMRALYYQYRDRKLRKREFRRLWIARINAAVRAYGLNYSTFINGLKKAGIELDRKILADMAVRDPQAFEQVVNKVKEALQVQ

SEQ ID NO: 159 - protein, 63 aa, Aquifex aeolicus
MAVPKAKTSKWRRNQRRAQNFFNKFRRSLPSLSVCSNCGERIIPHRVCPYCGHYKGKEVIETE

SEQ ID NO: 160 - protein, 98 aa, Aquifex aeolicus
MYAVIKTGGKQYKVEKGMKLKVEKLPYEVGQTVEFEALMLRKDDGSIEFNKGKVIAEVKAHGRGKKLIVFKYRPKKNYKRWKGHRQPYTEIEIKDILP

SEQ ID NO: 161 - protein, 149 aa, Aquifex aeolicus
MVELHDLQPHWGATKEKKRVGRGIGSGHGKTAGRGHKGQKSRSGDRKMPPYFEGGQTPLYMRIPKRGFKNPTRKEYTPVNVGVIDKLFEDGMEITPEVLASKGLCDEKDRVKILGDGELTKKFVIKAHAFSKSAKEKIEKAGGKWEIIS

SEQ ID NO: 162 - protein, 125 aa, Aquifex aeolicus
MSKLKVKLLRGLAGESERHIQAVKSLGLKKRGQERILEDNPLVWGNIRKAFHLVGVAYRIDFSGDIPTVERDLSEKPDYTVINKNGVYTNGKGVYYFSRITDLEDFLRKKGYKKYKNWKGEEVEL

SEQ ID NO: 163 - protein, 124 aa, Aquifex aeolicus
MPRLKTRREKRLRRHKRIRKKVFGTPERPRLCVYRSLKHFYAQIIDDTIGHTLVSASTLDPEFEKITGKRGGKSIKDAEVVAEIIARRALEKGIKKVVFDRGGFKYHGKIKAFADKCREMGLEF

SEQ ID NO: 164 - protein, 168 aa, Aquifex aeolicus
MSAVDPIADMFSAIKNAIMRRDDFLYVPSSKLKERILDVLKKEGFIQDWEALKGEKYEEEYKKMKELAEKSPNPKMKRYLKQLEEYNKGTQYPIKIYLKYLDPKKRKSAITNIVKVSKGGRRVYAGVRTMPYVKRGLGIAIVSTDAGVMTDHEARRMRKGGEVIAFVW

SEQ ID NO: 165 - protein, 62 aa, Aquifex aeolicus
MPRKAKVAKDLMYYPKWKSRKKNRCPICGRPRAFIRYFNMCRICFREHALRGDLPGVRKASW

SEQ ID NO: 166 - protein, 132 aa, Aquifex aeolicus
MAAAKIKKGDTVLVVRGKEKGKQGKVLKVYERVKRRDKQGNPVYVRHFVIVEGVRLIKKHVKPIEGVREGGIIETEGPIDISNVMLICPNCNKPTRVGFRIVEEGNVRRKYRYCKKCNENIDLVSEKVIKGG

SEQ ID NO: 167 - protein, 113 aa, Aquifex aeolicus
MSRVRVPSPSPFAVSGGKEMPNTRQAKKRMRRDAKRRLRNRYHLSRMRTYIKNFRRMIENGEIDKAKEYINEVISVIYHTAAKGVIHKNEAARRASRVYKLLNKALQQQQAQA

SEQ ID NO: 168 - protein, 98 aa, Aquifex aeolicus
MASKASGGSTRNGRDSISKRLGVKRYDGQFVKAGNIIVRQRGTRIYPGKNVGMGSDYTLFALKDGYVYFETRRKKKFVSVLSPEEWEKVMAQKNGKVH

SEQ ID NO: 169 - protein, 160 aa, Aquifex aeolicus
MPRKGPVPPREIPPDPKYGDVLVQKLINKVMKDGKKSVAEWIVYTALEEAAKEVNMHPVELLHKVIEKLKPEWEVRPTRVGGATYQVPIEVPERRQISLAIKWLVQAARERPRGREQYTMIERLKAELLDALNERGGAYKKKEETHRMAHANMVFSHFRW

SEQ ID NO: 170 - protein, 144 aa, Aquifex aeolicus
MKTYRIKPEEVERKWWVVDATGKTLGRLASEIAKILRGKHKPYYQPDVDCGDFVIVINAEKIRVTGKKLEQKKYYWHSRYPGGLKERTLKWMLENKPEEVIRLAVKRMLPKNRLGHRMLKKLKVYRGPEHPHQAQKPQPLEVKA

SEQ ID NO: 171 - protein, 147 aa, Aquifex aeolicus
MIQKLKDFKLTPENTYYATGKRKEAVARVWLLRDRPNTFIVGSDKTNKEYDLREYVQRETLYNKIMYPFKVTGHEGKFGIYATVRGGGISAQAEAIMYGVAKALLQHNPDLRPTLKKAGLLTRDAREKERKKYGQMGARAKYRWSKR

SEQ ID NO: 172 - protein, 145 aa, Aquifex aeolicus
MAKKVVATIELMLPAQQASPAPPVGPALGQHGVNIMEFVKQFNAASRDYEPGTILPVVITVYQDRSFTFIMKTPPVSYLLKKAAGVEKGSSDPKRVKVGKITVKQLEEIAKMKMKDMNTRDLKAAMRTVAGTAKSMGIEIEGWKE

SEQ ID NO: 173 - protein, 154 aa, Aquifex aeolicus
MSSELLRKIEQKYLPKKEYPDFRVGYTVRVYYKIKEGDKERIQPFEGVVIRIRGSGAGKTFTVRRESFGVGIERTFPYYSPNIEKIEVVKIGKVRRAKLYYLRELKGKEAERKIKEIKQWEYEAMQRRKEEARKQREEEQKQAQEQAQEQEQNA

SEQ ID NO: 174 - protein, 149 aa, Aquifex aeolicus
MKVVLVKDVEGLGFFGDVVNVKDGYAMNYLIPRGLALPATEGNIKHIQTILAQKERKLLREKKKAEELAKKLEGMVIGIKKPAGEGGKLFGSVTPADIVNALKEKGIEIERKNVVFYHPIKEVGVFPVKIRLHKDVEVDIKVDVKPEEK

SEQ ID NO: 175 - protein, 144 aa, Rhodobacter capsulatus
MPLYEHVLIARQDLSNAQAEGLIEHFSTVIGDNGGKVLGTEYWGVKTMAYKINKNRKGHYGFLRTDAPSAAVQEMERLARLHDDVMRVLTIKVDGHDEGPSVQMQKRDDRGDREERGDRGDRGDRGPRGDRGPREDRGPRPERR

SEQ ID NO: 176 - protein, 75 aa, Rhodobacter capsulatus
MATKPFFRRRKVCPFSGDNAPKIDYKDVRLLQRYISERGKIVPARITAVSAKKQRELAQAIKRARFLALLPYAVK

SEQ ID NO: 177 - protein, 64 aa, Vibrio cholerae
MPKMKNNKGAAKRFKKTAGGIKYKHATKRHILTKRTTKNKRQLRPNAILPKCELAAVARMLPYA

SEQ ID NO: 178 - protein, 117 aa, Vibrio cholerae
MPRVKRGVQARARHKKVLKQAKGYYGARPRVYRVAFQAVIKAGQYAYRDRRAKKRQFRQLWIARINAAARQNGLSYSRFINGLKKASIEIDRKILADIAVFDKAAFAVLVEKAKGAL

SEQ ID NO: 179 - protein, 86 aa, Campylobacter jejuni
MAEKRKYSRKYCKYTEAKVEFIDYKDTAMLKHALSERFKIMPRRLTGTSKKYQEMVEVAIKRARHVALIPYIVDRKEVINNPFEGL

SEQ ID NO: 180 - protein, 139 aa, Streptomyces coelicolor
MAVKIKLKRLGKIRSPHYRIVVADSRTRRDGRAIEEIGKYHPTYNPSVMEVDAERVAYWLGVGAQPTEPVLAILKKTGDWQKFKGEPAPAPLLQPAEKAARPSFEAIGGEDEGKGEAITQKKKADKKDEAAAESSASEA

SEQ ID NO: 181 - protein, 116 aa, Streptomyces coelicolor
MSHLLDSVDAASLRSDVPAFRPGDTVNVHVRVIEGNRSRVQQFKGVVIRRQGAGVRETFTVRKVSFSVGVERTFPVHTPIVEKIELVTRGDVRRAKLYYLRELRGKAAKIKEKRDS

SEQ ID NO: 182 - protein, 128 aa, Aquifex aeolicus
MPTFNQLVKYGREKRKKKSKAPALQGCPQKRGVCVRVYTVTPKKPNSALRKVARVRLSNGIEVTAYIPGEGHNLQEHSIVLVRGGRVKDLPGVRYKIIRGALDAAGVEGRRQSRSKYGTKRPKEEKGG

SEQ ID NO: 183 - protein, 151 aa, Mus musculus
MAPRKGREKKEEQVISLGPQVAEGENVFGVCHIFASFNDTFVHVTDLSGKETICRVTGGMKVKADRDESSPYAAMLAAQDVAQRCKELGITALHIKLRATGGNRTKTPGPGAQSALRALARSGMKIGRIEDVTPIPSDSTRRKGGRRGRRL

SEQ ID NO: 184 - protein, 159 aa, Cyprinus carpio
MADIQNERAYQKQPTIFQNKKRVLAVEGSGKEKLPRYHRNVGLGFKTPREAIAGTYIDKKCPFTGNVSIRGRILSGVVTKMKMQRTIVIRRDYLHYIRKYNRFEKRHKNMSVHLSPCFRDVTVGDIVTVGECRPLSKTVRFNVLKVTKAAGAKKQFQKF

SEQ ID NO: 185 - protein, 77 aa, Pyrococcus horikoshii
MEVKVFRVSGYFEKDGRKFKFTKEYRALKEEHVKELVYSDIGSRHKVKRRKIFIKEIREIKPEEAEDIVVRRLSLEL

SEQ ID NO: 186 - protein, 97 aa, Pyrococcus horikoshii
MVQKPHSFRRKTRKKLRKHPRRRGLPPLTRFLQEFEVGQKVHIVIEPSYHKGMPDPRFHGRTGTVVGKRGDAYIVEVPDGNKVKTLFIHPVHLRPQK

SEQ ID NO: 187 - protein, 51 aa, Pyrococcus horikoshii
MARFPEAEARIFKKYICLRCGATNPWGAEKCRKCGYKRLRPKAREPRGGGR

SEQ ID NO: 188 - protein, 71 aa, Pyrococcus horikoshii
MAEDEGYPAEVIEIIGRTGTTGDVTQVKVRILEGRDKGRVIRRNVRGPVRVGDILILRETEREAREIKSRR

SEQ ID NO: 189 - protein, 148 aa, Pyrococcus horikoshii
MVDFRHIVRVAGVDLDGNKQLRWALTAIKGVGINFATMVCRVAGLDPFMKAGYLTDEQVKKIEEILQDPVSHGIPRWAVNRPKDYETGKDLHLITAKLDMAIREDIMRLRRIRAYRGIRHELGLPVRGQRTRSNFRRGQTVGVSKKKK

SEQ ID NO: 190 - protein, 56 aa, Pyrococcus horikoshii
MAKADYNKRKPRKFGKGARRCIRCGQYGPIIRIHGLMLCRHCFREVAPKLGFRKYE

SEQ ID NO: 191 - protein, 60 aa, Pyrococcus horikoshii
MSIEEIDAKIRELRLQLAKERGMLTMGTSLENPMVIRNLRRDIARLLTIKKEKLREMGKK

SEQ ID NO: 192 - protein, 86 aa, Pyrococcus horikoshii
MDPYKVIIRPVVTEKAISLIEKENKLTFIVDRRATKTDIKKAIEEIFNVKVEKVNTLITPKGEKKAYVKLKPEYSASEIAARLGLF

SEQ ID NO: 193 - protein, 88 aa, Schizosaccharomyces pombe
MAPKKKWSKGKVKDKAQHATVFDKSIIDRINKEVPAFKFISVSVLVDRMKINGSLARIAIRDLAERGVIQKVDQHSKQAIYTRAAASA

SEQ ID NO: 194 - protein, 55 aa, Schizosaccharomyces pombe
MAKKNKARLLVKLLSTAGTGFFYVRSRPKAAPKLAFIKYDPKIHKRVLFEESKMK

SEQ ID NO: 195 - protein, 91 aa, Schizosaccharomyces pombe
MTKGTQSFGMRHNKSHTICRRCGKRSFHIQKSTCACCGYPAAKTRSYNWGAKAKRRRTTGTGRMSYLKKVHRSFKNGFRSGKPAAAVAASA

SEQ ID NO: 196 - protein, 125 aa, Schizosaccharomyces pombe
MSVNPKAFPLADSGLTQQILDLVQQASHYKQLRKGANEATKTLNRGISEFIVMAADTEPIEILLHLPLLCEDKNVPYVFVPSKAALGRACGVSRPVISASITTNEASDLLPQIQAIKLAIEKLLI

SEQ ID NO: 197 - protein, 149 aa, Schizosaccharomyces pombe
MKVEVCSFSGSKVYPGAGRLFVRGDNKVFRFVNKKSESLFLQRKNPRRLSWTVLYRRMHKKGISEEHAKKRTRRTVKHQRGIVGANLDVIKEKRNQRPEVRAAARAAALKQRKDKRAASESEKKAIKAKSAASSARGQAIKNAKVAARR

SEQ ID NO: 198 - protein, 65 aa, Homo sapiens [sequence omitted]

SEQ ID NO: 199 - protein, 125 aa, Trypanosoma brucei brucei
MRTIDCEFSHFAVHPGHGRRYVPFAFLSTKPVLTFARPKCFAMYMRKKNPRFIAWTRTYRRIHRKTTTDRVGRRRAARTVRAERAIVGAELSYIQEVRAKAKKVDRTAKGKAVREEMAARKAAKK

SEQ ID NO: 200 - protein, 154 aa, Dictyostelium discoideum
MPLIPTENKLAIYRYLFQEGVLVAPKDFHLAKHPQIETVSNLDVLQILRSFKSRKFVTETFNWQYYYWVLTEEGIKYLRTYLQVPESVVPATMKKQASRPSTYTRSEETKRTGASGDFDPSFNRGDRRQGGDRRGGMGRGQYRTERSAPAPQQN

SEQ ID NO: 201 - protein, 156 aa, Lumbricus rubellus
MLMSKKNRVMIYEYLFKEGVLVAKKDFHLPKHGEIDVPNLHVIRAMQSLVSRGYVKEQFCWRHYYWYLQNEGIQYLRDFLHLPPEIVPATLKRQTRPEAARPRPKEGAPRAQVGEDRAGYRRGFGGSDKKGEAGAGADTNFQFRGGFGRGRQEQEE

SEQ ID NO: 202 - protein, 151 aa, Lumbricus rubellus
MGRMHAPGKGISQSALPYRRSVPTWLKLGPDDVKEQIYKLAKKGLTPSQIGVILRDSHGVAQTRHVAGNKILRILKAKGLAPTIPEDLYFLIKKAVAIRKHLERNRKDKDSKFRLILVESRIHRLARYYKTRKVLPPVWKYESATASALVA

SEQ ID NO: 203 - protein, 131 aa, Toxoplasma gondii
MVKFKLKIIKLILHTELTNFLSSLSSILGPIGININLFFQEYNKRIKLKNNIDLPLHIIVYNDKSYVLNFNLIYTSFFFITKLQKVFKKKQNKQYLIKKFSFLKQIKLFPKSNISICKTIKATLNSFYNIN

SEQ ID NO: 204 - protein, 138 aa, Eimeria tenella
MYSLNNLIYFLLIKKLIKSGNQHKSISLKKNLLLLINDKVLLYAILKLIVPITFKIKKIGYIKYQIPTLTHYYKSINLALIWLIKAAKIKSFNKMPFIKALYLECYDVLKKQGIAYNYKQQYIKKSLTNRIFIYLIKK

SEQ ID NO: 205 - protein, 108 aa, Flammulina velutipes
MAIRLRWALHGVRHNRILHLVAINNRKARNAKPKELLGVYNPHVAPLVAPGFGPAMLKAEPAERRRWLSVGARPRRSVARMLERGGILTWESLYGSGSTTRTSAPQGG

SEQ ID NO: 206 - protein, 114 aa, Pylaiella littoralis
MHLTNKKYICEVWFSSTNLKSLKYCLLLLPRPCFSTGLSTSRKRFTLLRSPLGNKTSKDQFERREYRNYLYFFSDKPYKVLAFLDVLRYSIGVKSKIVLSVHLEKKSHPQPRKR

SEQ ID NO: 207 - protein, 69 aa, Pylaiella littoralis
MLKKKIIKYNIFGNVLSDGSFHFCLLTNSYLKESLNYKSVDILNHPVWTGKRQKEQTEISLFIGRLTSK

SEQ ID NO: 208 - protein, 118 aa, Arabidopsis thaliana
MASLILGAPPRVTVALPSSRLSSSHSETAGVSLSCFTHQFSLSTSSSSSIPLVYCGRGDRKTAKGKRFNHSFGNARPRNKSKGRGPERVPVPPAPPRKDKFENDEKIKIDIDESLFSN

SEQ ID NO: 209 - protein, 123 aa, Arabidopsis thaliana
MARIKVHELREKSKADLSGQLKEFKAELALLRVAKVTGGAPNKLSKIKVVRKSIAQVLTVISQKQKSALREAYKNKKLLPLDLRPKKTRAIRRRLTKHQASLKTEREKKKEMYFPIRKYAIKV

SEQ ID NO: 210 - protein, 154 aa, Arabidopsis thaliana
MSPAKVDTTKKADPKAKALKAAKAVKSGQAFKKKDKKIRTKVTFHRPKTLTKPRTGKYPKISATPRNKLDHYQILKYPLTTESAMKKIEDNNTLVFIVDIRADKKKIKDAVKKMYDIQTKKVNTLIRPDGTKKAYVRLTPDYDALDVANKIGII

SEQ ID NO: 211 - protein, 136 aa, Arabidopsis thaliana
MCVEAIMVRASVLNDCLKSMSNAEKQGKRQVMIRPSSKVIIKFLTVMQKHGYIAEFEYVDDHRSGKIVVELNGRLNNCGVISPRYDLGVKEIEGWTAKLLPSRQFGYIVLTTSAGIMDHEEARKKNVGGKVLGFFY

SEQ ID NO: 212 - protein, 113 aa, Arabidopsis thaliana
MTTPAVKTGLFVGLNKGHVVTRRELAPRPNSRKGKTSKRTIFIRKLIREVAGMAPYEKRITELLKVGKDKRALKVAKRKLGTHKRAKRKREEMSSVLRKMRSLGGAAAAEKKM

SEQ ID NO: 213 - protein, 110 aa, Arabidopsis thaliana
MRVLRDGQSGGGANEGAKAEKTVFEVKLESFEARAKIKIIKEVRRIIGVGLKEAMKLVVKAPTVLKTGLSKEEGEEVVEKLNALGAEAVLQTRVSDIPSLFWNSLFHLIS

SEQ ID NO: 214 - protein, 68 aa, Arabidopsis thaliana
MIVINLAGKVHGSLARAGKVRGQTPKVAKQDKKKKPRGRAHKRLQHNRRFVTAVVGFGKKRGPNSSEK

SEQ ID NO: 215 - protein, 129 aa, Arabidopsis thaliana
MGRRILNDALRTIVNAEKRGKASVELKPVSTVMSSFLKIMKEKGYIKNFQVHDPHRVGRITVDLQGRVNDCKALTYRQDVKANEIGQYTERTLPTRQWGYIVITTPDGILDHEEAIKRNVGGQVLGFFH

SEQ ID NO: 216 - protein, 129 aa, Arabidopsis thaliana
MASLSMASVNVSFCHPLRSSSPKVSLRSSVHFATSLSSSHSISGLRAVLPLKISTVASPNSQKLHSFTVFAHKGYKMKTHKASAKRFRVTGRGKIVRRRSGKQHLLAKKNNKRKLRLSKMVHGSEPERL

SEQ ID NO: 217 - protein, 150 aa, Petunia hybrida
MTTRFKKNRKKRGHVSAGHGRIGKHRKHPGGRGNAGGMHHHRILFDKYHPGYFGKVGMRYFHKLRNKFYCPTVNIDKLWSLVPQDVKDKVAAGGAKGTAPLIDVTQYGYFKVLGKGVLPENQAVVVKAKLVSKNAEKKIKEAGGAVVLTA

SEQ ID NO: 218 - protein, 95 aa, Bacillus stearothermophilus
MKDPRDIIKRPIITENTMNLIGQKKYTFEVDVKANKTEVKDAVEKIFGVKVAKVNIMNYKGKFKRVGRYSGYTNRRRKAIVTLTPDSKEIELFEV

SEQ ID NO: 219 - protein, 38 aa, Treponema pallidum
MQHMHRIIGQMIRTRGLKNVRCMAVEGKHNGRKNGARA

SEQ ID NO: 220 - protein, 108 aa, Chlamydia trachomatis
MKKNTHPEYRQVLFVDSSTGYKFVCGSTYQTDKTEVFEGQEYPVCYVSVSSSSHPFFTGSKKLVDAEGRVDKFLKRYSGIKQSAPKPETVVEDVLPKGKKKSPAKKKK

SEQ ID NO: 221 - protein, 116 aa, Chlamydia trachomatis
MALKIRLRQQGRKNHVVYRLVLADVESPRDGKYIELLGWYDPHSEQNYQLKSERIFYWLNQGAELTEKAGALVKQGAPGVYAELMAKKVARRAVVRQKRRAYRQRLAARKAEAAAK

SEQ ID NO: 222 - protein, 121 aa, Chlamydia trachomatis
MGNLIKELQDEQCRTDLADFCVGDTIRVATNISEGGKERVQVFQGTVMARKGGGAGETVSLHRVAYGEGMEKSFLLNSPKIVSIEVVKRGKVSRARLFYLRGKTGKAAKVKELIGSRAAKK

SEQ ID NO: 223 - protein, 89 aa, Chlamydia trachomatis
MSKKCALTGRKPRRGYSYAIRGISKKKKGIGLKVTGRTKRRFFPNMMTKRLWSTEENRFLKLKISAAALRLVDKLGLDQVVARAKSKGF

SEQ ID NO: 224 - protein, 150 aa, Chlamydia trachomatis
MEKRKDTKTTLAKASDDRNKAWYVVNAEGKTLGRLSSEVAKILRGKHKVTFTPHVAMGDGVIVINAEKVRLTGAKRAQKVYHYYTGFISGMREVPFENMIARKPAYVIEHAVKGMLPKTKLGRRQMKSLRVLKGSSYAQYEAIKPIVLDA

SEQ ID NO: 225 - protein, 129 aa, Chlamydia trachomatis
MIQESVATGRRKQAVSSVRLRSGNGKIDVNGKTLEQYFPLEVQRATILAPLRMLGDVNSFDLIIRVSGGGVQGQVIATRLGLARAVLQEKEDMKQELKAQGFLTRDPRKKERKKYGRKKARKSFQFSKR

SEQ ID NO: 226 - protein, 52 aa, Chlamydia trachomatis
MASKNREIIKLKSTESSEMYWTVKNKRKTSGRLELKKYDRKLRKHVIFKEAK

SEQ ID NO: 227 - protein, 141 aa, Chlamydia trachomatis
MSNKKIIKIIKLQIPGGKANPAPPIGPALGAAGVNIMGFCKEFNAATQDRPGDLLPVVITVYSDKTFSFVMKQSPVSSLIKKALGLESGSKIPNRNKVGKLTRAQITVIAEQKMKDMDVVLLESAERMVEGTARSMGVDVE

SEQ ID NO: 228 - protein, 58 aa, Chlamydia trachomatis
MPSVKVRVGEPIDRALRILKKKIDKEGILKTSKSHRFYDKPSVKKRAKSKAAAKYRGR

SEQ ID NO: 229 - protein, 83 aa, Chlamydia trachomatis
MAHKKGQGASRNGRDSESKRLGLKVGAGQRVSTGSILVRQRGTKWHPAVNVGRGKDDTLFALVDGIVVMKKTDRTYVSVIPQA

SEQ ID NO: 230 - protein, 107 aa, Chlamydia trachomatis
MEPYAVIQTGNKQYQVRKGDVIDVELLDGISEENKEVLFQDVLFTFDGEKASVGAPTVGNAVVKGELVSFVRGEKVVAYKYKKRKNYHKKIGHRQNYLRVKISDLVM

SEQ ID NO: 231 - protein, 105 aa, Chlamydia trachomatis
MKQQKQRIRIRLKGFDQGQLDQSTANIVETAKRTGARVVGPIPLPTKREVYTVLRSPHVDKKSREQFEIRTHKRLIDILDPTGKTIDALKMLSLPAGVDIKIKAA

SEQ ID NO: 232 - protein, 157 aa, Chlamydia trachomatis
MSRRHAAEKKVIPGDPVYGSVVLERFINKVMLHGKKSIARKIVYGALERFAKRLGLENPLEGFEEALENAKPVLEVRSRRVGGATYQVPVEVAPDRRSCLAMQWIIKHARSKPGKCMEVGLANELIDCFNKQGATIKKREDTHRMAEANKAFAHYKW

SEQ ID NO: 233 - protein, 123 aa, Chlamydia trachomatis
MPTINQLIRKKRQSGATRKKSPALQKSPQKRGVCLQVKTKTPKKPNSALRKVAWVRLSNGQEVIAYIGGEGHNLQEHSIVLVQGGRVKDLPGVRYHIVRGALDCAAVKNRKQSRSRYGAKRPK

SEQ ID NO: 234 - protein, 141 aa, Chlamydia trachomatis
MQHARKKFRVGRTSSHNRCMLANMLKSLIHNERIETTLPKAKELRRHADKMITLAKKNTLAARRLAVGRLMVRYNTLTSKEARQVKAGDLSAYNVDRRVIGKLFDVLATRFSSRNGGYTRILKLQNRVGDNAQKCIIEFLA

SEQ ID NO: 235 - protein, 132 aa, Chlamydia trachomatis
MVKNQAQKKGVKRKQVKNIPSGVVHVKATFNNTIVTITDPAGNVISWASAGKVGYSGSRKSSAFAATVAAQDAAKAAMSSGLKEVEVGLKGTGAGRESAVRALISSGLIVSVIRDETPVPHNGCRPRKRRRV

SEQ ID NO: 236 - protein, 144 aa, Chlamydia trachomatis
MIKLECLQDPSPRKRRTKLLGRGPSSGHGKTSGRGHKGDGSRSGYKRRFGYEGGGVPLYRRVPTRGFSHTRFDKCVEEITTQRLNEIFDNGAEVSLEALKERKVIHRETSRVKVILKGALDKKLVWKDAAIVLSEGVKSLIEAV

SEQ ID NO: 237 - protein, 123 aa, Chlamydia trachomatis
MESSLYKKTSGKARRALRVRKALKGCSLKPRLSVVKTNKHVYVQLIDDVEGKTLASISTLAKVAKTSGLTRKNQDNAKALGIKIAELGKGLQVDRVVFDRGAHKYHGVVAMVADGAREGGLQF

SEQ ID NO: 238 - protein, 183 aa, Chlamydia trachomatis
MSRKARDPIVLPQGVEVSIQNDEISVKGPKGSLTQVLAKEVEIAVKGNEVFVTPAAHVVDRPGRIQGLYWALIANMVKGVHTGFEKRLEMIGVGFRAAVQGSLLDLSIGVSHPTKMPIPTGLEVSVEKNTLISIKGINKQLVGEFAACVRAKRPPEPYKGKGIRYENEYVRRKAGKAAKTGKK

SEQ ID NO: 239 - protein, 133 aa, Chlamydia trachomatis
MGMTSDSIANLLTRIRNALMAEHLYVDIEHSKMLEAIVRILKQHGFVAHFLVKEENRKRLMRVFLRYGEDRRPVIHALKRVSKPSRRVYVSAAKIPYVFGNMGIAVLSTPQGVLEGSVARAKNVGGELLCLVW

SEQ ID NO: 240 - protein, 111 aa, Chlamydia trachomatis
MKRRSVCVGDTVYVLAGNDKGKQGKVLRCLKDKVVVEGINVRVKNIKRSQENPKGKRINIEAPLHISNVRLSIDNQPARLFVKVREKGRELWNKHSDGSSSLYRSVRERKG

SEQ ID NO: 241 - protein, 122 aa, Chlamydia trachomatis
MIQQESQLKVADNTGAKKVKCFKVLGGSRRRYATVGDVIVCSVRDVEPDSSVKKGDVVKAVIVRTRNDIHRKDGSTLRFDTNSCVIIDDKGNPKGTRIFGPIAREIRDRGFVKISSLAPEVI

SEQ ID NO: 242 - protein, 72 aa, Chlamydia trachomatis
MGAKKNLLAELREKSSEELDEFIRDNKKALFALRAEAALQNKVVKTHQFSLYKKSIARALTIKQEKKDRVHG

SEQ ID NO: 243 - protein, 138 aa, Chlamydia trachomatis
MLMPKRTKFRKQQKGQFAGLSKGATFVDFGEFGMQTLERGWITSRQIEACRVAINRYLKRKGKVWIRVFPDKSVTKKPAETRMGKGKGAPDHWVVVVRPGRILFEVANVSKEDAQDALRRAAAKLGIRTRFVKRVERV

SEQ ID NO: 244 - protein, 111 aa, Chlamydia trachomatis
MFKATARYIRVQPRKARLAAGLMRNRSVVEAQQQLSFSQMKAGRCLKKVLDGAIANAESNENIKRENLCVLEVRVDVGPMFKRMKSKSRGGRAPILKRTSHLTVIVGERGQ

SEQ ID NO: 245 - protein, 88 aa, Chlamydia trachomatis
MSRSLRKGPFVDHHLLKKVRDMNALEKKTPIKTWSRRSMITPEMIGHTFEVHNGRKFLTVFVSETMVGHKLGEFSPTRMFKSHPVKKG

SEQ ID NO: 246 - protein, 111 aa, Chlamydia trachomatis
MKDPYDVVKRHYVTEKAKMLEGLSLGDGEGKKKGSFCKDPKYIFIVAGDATKPMIAEAIEAIYSAKGVKVKKVNTMCVKPQPTRIFRGRRKGRTAGFKKAIVTFVDGHSIG

SEQ ID NO: 247 - protein, 98 aa, Chlamydia trachomatis
MAPRKPSKKVGPQKRPSAEKRVITSKKKQLRNQSFKSKVRTILKKFELAVQSGDVESISAGLRSVYSIADKAVKRGIFKKGKADRVKSRTSERACPAA

SEQ ID NO: 248 - protein, 45 aa, Chlamydia trachomatis
MKRTYQPSKRKRRNSVGFRARMATKSGRNLLNRRRRHGRHSLIDL

SEQ ID NO: 249 - protein, 45 aa, Chlamydia trachomatis
MRVSSSIKADPSKGDKLVRRKGRLYVINKKDPNRKQRQAGPARKK

SEQ ID NO: 250 - protein, 101 aa, Chlamydia trachomatis
MAKKSAVAREVKRRKLVEANFQKRAELRKLAKSLSVSEEERERAREALNKMRRDTSPSRLHNRCLLTGRPRGYLRKFAISRICFRQMASMGDIPGVVKASW

SEQ ID NO: 251 - protein, 112 aa, Chlamydia trachomatis
MKKKTGQLYEGAYVFSVTLSEDARRKALEKVTSGITNYGGEVLKIHDQGRKKLAYTIRGAREGYYYFIYFTVAPEAIAELWREYHLNEDLLRFMTLKASAVKEVLEFATLPE

SEQ ID NO: 252 - protein, 81 aa, Chlamydia trachomatis
MNRPVHNEHRRKRFAKKCPFVSAGWKTIDYKDVTTLKRFITERGKILPRRITGVSSRFQALLAQAVKRARHVGLLPFVGED

SEQ ID NO: 253 - protein, 59 aa, Chlamydia trachomatis
MAVPRNRHSNARKNIRRSHHAKKACSAAVCSNCKQAFIPHTVCASCGFYKGKAVITVEK

SEQ ID NO: 254 - protein, 64 aa, Chlamydia trachomatis
MPKMKSNKSVAARFKLTGSGQLKRTRPGKRHKLSKRSSQQKRNLSKQPLVDQGQVGMYKRMMLV

SEQ ID NO: 255 - protein, 123 aa, Chlamydia trachomatis
MVRATGSVASRSRRKRVLKQAKGFWGDRKGHFRQSRSSVMRAMAFNYMHRKDRKGDFRSLWITRLSVASRIHGLSYSRLINGLKQAGIHLNRKMLSEMAIHDPQGFAVVATQAKLALEAAVQG

SEQ ID NO: 256 - protein, 112 aa, Chlamydia trachomatis
MYINKPLRYNWSLRHFLYLRRHRMSLDKGTKEEITKKFQLHEKDTGSADVQIAILTEHITELKEHLKRSPKDQNSRLALLKLVGQRRKLLEYLNSTDTERYKNLIARLNLRK

SEQ ID NO: 257 - protein, 115 aa, Coxiella burnetii
MEVAAKLKYARISAQKARLVADQVRGLGAEQAVNLLRFSNKKAAALMKKVLDSAIANAEHNEGADIDELKVSTVMVDEGPSARRFHARARGRANQILKRTCHITVKVSDSQVEND

SEQ ID NO: 258 - protein, 46 aa, Pseudanabaena sp.
MTKRTLRGSVRKKKRTSGFRARMETPTGRRVIKARRSRGRVRLTTV

SEQ ID NO: 259 - protein, 95 aa, Streptomyces coelicolor
MSLDAAVKKQIITEFGTKEGDTGSPEVQVALLSRRISDLTEHLKTHKHDHHSRRGLLILVGQRRRLLQYLAKKDIQRFRALVERLGIRRGAAGAR

SEQ ID NO: 260 - protein, 37 aa, Streptomyces coelicolor
MKVKPSVKKICDKCRVIRRHGRVMVICDNPRHKQRQG

SEQ ID NO: 261 - protein, 126 aa, Streptomyces coelicolor
MARVSGVDIPREKRVEIALTYVFGIGRTLSQQTLAATGVDPNTRVRDLSEEQLVAIREYVDNNIKTEGDLRREVQADIRRKVEIGTYQGLRHRRGLPVRGQRTSTNARTRKGPRRAIAGKKKPGKK

SEQ ID NO: 262 - protein, 168 aa, Streptomyces coelicolor
MPKPSKGARLGGSAAHEKLLLANLAKSLFEHGRITTTEAKARKLRPYAERLVTKAKKGDLHNRRQVLQVITDKSIVHTLFTEIGPRYENRPGGYTRITKIGNRRGDNAPMAVIELVEALTVAQQATGEAEAATKRAAKDAEGSAEVSEAKVDTTKADDEAAAEESKDA

SEQ ID NO: 263 - protein, 139 aa, Streptomyces lividans
MAVKIKLKRLGKIRSPHYRIVVADSRTRRDGRAIEEIGKYHPTYNPSVMEVDAERVAYWLGVGAQPTEPVLAILKKTGDWQKFKGEPAPAPLLQPAEKAARPSFEAIGGEDEGKGEAITQKKKADKRDEAAAESSASEA

SEQ ID NO: 264 - protein, 144 aa, Streptomyces antibioticus
MPPKKKKVTGLIKLQIQAGAANPAPPVGPALGQHGVNIMEFCRAYNAATESQRGWVIPVEITVYEDRSFTFITKTPPAAKMILKAAGIEKGSGEPHKTKVAKITEAQVREIATTKLPDLNANDLDAAAKIIAGTARSMGVTVEG

SEQ ID NO: 265 - protein, 144 aa, Streptomyces lavendulae
MPPKKKKVTGLIKLQIKAGAANPAPPVGPALGQHGVNIMEFCKAYNAATESQRGMVVPVEITVYEDRTFTFITKTPPAARLILKAAGIEKGSGEPHKTKVAKLTGAQVREIAELKMPDLNANDVDAAMKIIAGTARSMGVTVEG

SEQ ID NO: 266 - protein, 89 aa, Pseudomonas putida
MALSVEEKAQIVAEYQQTAGDTGSPEVQVALLTANINKLQGHLKPTTKTTTPVRGLIRMVNHRRKLLDYLKGKDTTRYSALIGRLGLRR

SEQ ID NO: 267 - protein, 127 aa, Streptomyces coelicolor
MARVKRAVNAHKKRRAILEQASGYRGQRSRLYRKAKEQVTHSLVYNYNDRKKRKGDFRQLWIQRINAAARANGITYNRFIQGLKAANVEVDRKILAELAVNDPNAFAALVEVAQKALPSDVNAPKAA

SEQ ID NO: 268 - protein, 64 aa, Streptomyces coelicolor
MPKNKSHSGASKRFKITGSGKVLRERAGKRHLLEHKSSRVTRRLTGNAEMAPGDAAKIKKLLGK

SEQ ID NO: 269 - protein, 126 aa, Schizosaccharomyces pombe
MKFSRDVTSSRRKQRKAHFGAPSSVRRVLMSAPLSKELREQYKIRSLPVRRDDQITVIRGSNKGREGKITSVYRKKFLLLIERVTREKANGASAPVGIDASKVVITKLHLDKDRKDLIVRKGGKVE

SEQ ID NO: 270 - protein, 88 aa, Caenorhabditis elegans
MFFPLSTMGFQNLWFSHPRKFGPGSRSCRVCAGHHGLIRKYGLDLCRRCFREQARDIGFKKQPASTSATASSNLVIVNFMSSINKLLA

SEQ ID NO: 271 - protein, 93 aa, Oryza sativa
MPRRSIWKGSFVDAFLFRIKKNRESLMSRKIWSRRSSISPEFVDCSVLIYNGKTPVRCKITEGKVGHKFGEFAFTRRRRPYQTNRGKGRKGKK

SEQ ID NO: 272 - protein, 125 aa, Sorghum bicolor milo
MPTKNQLIRHGREEKRRTDRTRASDQCPQKQGVCLRVSTRTPKKPNSALRKIAKVRLSNRHDIFAHIPGEGHNSQEHSIVLVRGGRVKDSPGVKSHRIRGVKDLLGIPDRRKGRSKYGAERPKSK

SEQ ID NO: 273 - protein, 81 aa, Zea mays
MQNEEGKTVDLYVPRKCSATNRIITAKDHASVQINIGHLDANGLYDGHFTTFALSGFVRAQGDADSSLDRLRQKKKADIKQ

SEQ ID NO: 274 - protein, 79 aa, Oryza sativa
MPKQIHEIKGLPPDGEEEGREVGADQEDQGRRQVQGALLQVPLHPLRLRRRQGQQAQAVAPPRFDCPGGLSIKARPCCL

SEQ ID NO: 275 - protein, 106 aa, Streptomyces griseus
MYAIVRSGGRQHKVAVGDIVEVDKISTAKVGDTVELSTLLVVDGDAVTSDPWVLDGIKVTAEIVDHHKGAKIDILRYKNKTGYRRRQGHRQQYTAIKVTGIPAAAK

SEQ ID NO: 276 - protein, 123 aa, Streptomyces lividans
MPTIQQLVRKGRQDKVEKNKTPALEGSPQRRGVCTRVFTTTPKKPNSALRKVARVRLTSGIEVTAYIPGEGHNLQEHSIVLVRGGRVKDLPGVRYKIIRGSLDTQGVKNRKQARSRYGAKKEK

SEQ ID NO: 277 - protein, 105 aa, Candida maltosa
MVNVPKTKKTYCKSKECKKHTLHKVTQYKKGKDSLAAQGKRRYDRKQSGYGGQTKPVFHKKAKTTKKIVLRLQCQGCKHVSQHPIKRCKHFEIGGDKKGKGTSLF

SEQ ID NO: 278 - protein, 153 aa, Homo sapiens
MARNVVYPLYRLGGPQLRVFRTNFFIQLVRPGVAQPEDTVQFRIPMEMTRVDLRNYLEGIYNVPVAAVRTRVQHGSNKRRDHRNVRIKKPDYKVAYVQLAHGQTFTFPDLFPEKDESPEGSAADDLYSMLEEERQQRQSSDPRRGGVPSWFGL

SEQ ID NO: 279 - protein, 135 aa, Anopheles gambiae
MARKARIIDVVYNASNNELIRTKTLVKNAIIVIDASPFRQWYESHYLLPLGKKRELKAGEEDVLSKKRTKSNLRKYVKRQKNAKIDPAVEEQFNAGRLLACISSRPGQVGRADGYILEGKELEFYLKKIKNKKSK

SEQ ID NO: 280 - protein, 151 aa, Brugia pahangi
MGRMHNPGKGISQSALPYRRSVPTWLELTSEEVQEQITRLAKKGLRPSQIGVILRDSHGVAQVRRVTGNKIVRILKAKGMAPEIPEDLYHLIKKAVNIRKHLERNRKDKDSKYRLILVESRIHHLARYYKTKRQLPATWKYESSTASALVS

SEQ ID NO: 281 - protein, 130 aa, Caenorhabditis elegans
MQIFLLGLDNTTHTLDVDASTTLSAIKGVIGAGEEFSISYGSKVLSEELTLGECQIESLSTLSVNGRLLGGKVHGSLARAGKVRAQTPKVDKQDKKKKKRGRAFRRVQYTRRYVNVASGPGKKRGPNSNS

SEQ ID NO: 282 - protein, 129 aa, Caenorhabditis elegans
MGIHRRTRLNVVDNSALGKEADTTGKLPYCIHVYKQGRRAKHMPHAELGDKILVAIRGQMRKAYVVGANTHVHYRKHGVPVTDQNMIVLLDEEGNPLGNRITAPIPTKLMANRGNVQFSKVLALANKFI

SEQ ID NO: 283 - protein, 172 aa, Dictyostelium discoideum
MTYISKKQAAKKVIVREKPILVRLKLIIGAGTASMTPPLGPNLGQYGINSIEFFNDFNTETKELFETGLALRVILWINVMKAFYFELQMPKISNLLKEYYKVECEAAKGGNVYIEKERLLKDCFKIAILLCTFNKAEKQWEQIEKKYLRITVLEILGTCRSCKIYVKKAENE

SEQ ID NO: 284 - protein, 140 aa, Dictyostelium discoideum
MITINQITDRKARGPKKKRKTLLTGYPQKKGYCMRVYETKPKKPNSAIRKVAKVTIKLKNKRKNLIAYIPGFGPHNLQPLSTVLVKGGRCQDLPGVKYRLVRKHYDFLAAERFVRKNRRSKFSVKNLETKAKKGKAVRIE

SEQ ID NO: 285 - protein, 162 aa, Dictyostelium discoideum
MIIKVQKTFEKRLINAFMRKGNYIKAEKIYLKVVNRLSTIGIKNSYQFIRETLLKMTPIMGVVKKKRGVKELIYPKYLEPEMGEKLAIKWLKKTVAKFKGELLIENIVEEFVKASKDQGEVVKEKWALYKEVRYAISCNTRKGHHKSFVEQKLKATQRRKWY

SEQ ID NO: 286 - protein, 87 aa, Dictyostelium discoideum
MVRSRWKGIYVAKELQNYNTVTNPTIVTTERSSVIVPYYLTKTIYVYNGRKYVGVKITEKSLGRKLGEYVLTKKVEKYKASGKSKKK

SEQ ID NO: 287 - protein, 36 aa, Plasmodium falciparum
MKKRSSIKKICNKCKLIKRFKKLHIICINKKHKQTQ

SEQ ID NO: 288 - protein, 92 aa, Crithidia fasciculata
MYIIFFIRGFYLYGLCLRLFIFLCVYYISPRLPSSGNRRLCCSIFWLSNIIFYVSVFFCCIYFVVFSQQLFIVEGGGFIDLPGIKYYSRFFY

SEQ ID NO: 289 - protein, 144 aa, Oenothera berteriana
VLYPKRTKYSKYRKGRCSRGCEPDGTQLSFGRYGTKSCRAGRLSYRAIEAARRATIGQFHRAMSGQSRRNGKIWVRVLADLPITGKPTEVRMGRGKGNPTGWIARVSTGQILFEMDGVSLSNARQAATLAAHKPCSSTKFVQWS

SEQ ID NO: 290 - protein, 171 aa, Petunia sp.
MLLRKYLLVTESQVSKCGFLIVKKKRDVLYPKRTKYSKYRKGRCSRGCKPDGTQLGFGRYGTKSCRAGRLSYRAIEAARRAIIGHFHRAMSGQFRRNGKIWVRVLADIPITGKPTEVRMGRGKGNPTGWIARVSRGQILFEMDGVSLSNARQAATLAAHKLCSSTKFVQWS

SEQ ID NO: 291 - protein, 174 aa, Triticum aestivum
MFLVDAGPGTPKICMQDELTGLPIKRATRFENKVGSKNVVAGESLIKKRIFERFFIDLVAGESLIKERAAARFNDFVGSLDVAAGEPLLLPQRFRQNRAWIELKKIWRTKKKVKGFIIKKIKGGYSVAIAGFTTFLPFKKALLKKRIANDRFTIDSINPKRRDIVIIAADQTRT

SEQ ID NO: 292 - protein, 139 aa, Solanum tuberosum
MRQRRALRRVSQKERPPKVTTTKIGIVIRSFDHPFLENHFWGLPPYTRKIGLPESRVLYTVLRSPHIDKKSREQFFMKIKKEFLVIKTERHELRKKFFRLKRQRIFGAQYEILFSCKTRSDKGKLQRLLRNKILALTLS

SEQ ID NO: 293 - protein, 169 aa, Arabidopsis thaliana
MKEEMLHMDINSMIGSSMPLGMMRIGTIIHNIEMNPGQGAKMVRAAGTNAKILKEPAKGKCLIKLPSGDTKWINAKCRATIGTVSNPSHGTKKLYKAGQSRWLGIRPKVRGVAMNPCDHPHGGGEGKSKSSGSRGRTSVSPWGKPCKGGYKSASVKKKKKRLAEAAAKM

SEQ ID NO: 294 - protein, 72 aa, Arabidopsis thaliana
MPAGSSERARTRDLFARPFRKKGYIPLSTYLRTFKVGRLRRCQGNGAIHKGSLISSTMVVLVASGISLTCVV

SEQ ID NO: 295 - protein, 109 aa, Arabidopsis thaliana
MYRKQHKKDAAQEAVKRRRRATKKPYSRSIVGATLEVIQKKRAEKPEVRDAAREAALREIKERIKKTKDEKKAKKVEYASKQQKSQVKGNIPKSSAPKAAKMGGGGGRR

SEQ ID NO: 296 - protein, 35 aa, Escherichia coli
MYNYYNPASLITHGFGVHRFIFRRISNKAIEFIQV

SEQ ID NO: 297 - protein, 64 aa, Pseudomonas aeruginosa
MGMRGGLTRLIEELSCPSQHARYAEGRCALRPPDRYWNRNGKFISARATGSISSTSKTCRCSRA

SEQ ID NO: 298 - protein, 157 aa, Synechococcus sp. (strain PCC 6301)
MNFARTCGLALAACLAGGAVLEAQPAAAGPDRWDRCERPGRGNRRACLEQLNRFNRFDQFDRRGVPIPVVDRRFLRSGSRMNLFFPGRDRIILRRGEVLPLEGRLARDIFDNRGRVLVPRNSRILGQLRPDGRGLRFVSDRLILPNGASIRFVLTLA

SEQ ID NO: 299 - protein, 110 aa, Thermus aquaticus
MRVKMHVKKGDTVLVASGKYKGRVGKVKEVLPKKYAVIVEGVNIVKKAVRVSPKYPQGGFIEKEAPLHASKVRPICPACGKPTRVRKKFLENGKKIRVCAKCGGALDTEE

SEQ ID NO: 300 - protein, 126 aa, Haemophilus parainfluenzae
MSRLDKSKVINSALELLNEVGIEGLTTRKLAQKLGVEQPTLYWHVKNKRALLDALAIEMLDRHHTHFCPLEGESWQDFLRNNAKSFRCALLSHRDGAKVHLGTRPTEKQYETLENQLAFYANKVFH

SEQ ID NO: 301 - protein, 146 aa, Rattus norvegicus
MARNVLYPLYQLGGPQLRVFRTNFFIQLVRPGTAQPEDTVQFRIPMEMTRVDLRNYLEQIYNVPVAAVRTRVQHGSNRRRDHKNVRIKKPDYKVAYVQLAHGQTFTFPDLFPEKEPTSPDPLEEELPQQRQSSDPRCPGIPSWFGL

SEQ ID NO: 302 - protein, 149 aa, Schizosaccharomyces pombe
MKVEVCSFSGSKVYPGAGRLFVRGDNKVFRFVNKKSESLFLQRKNPRRLSWTVLYRRMHKKGISEEHAKKRTRRTVKHQRGIVGANLDVIKEKRNQRPEVRAAARAAALKQRKDKKAASESEKKAIKAKSAASSARGQAIKNAKAAARH

SEQ ID NO: 303 - protein, 78 aa, Caenorhabditis elegans
MVQNNDVDGAFGLLNRLMDSEGMLKIIRRTQFYQKPYMQRKTLSMEASTAIFNEDMNRKMKFLVRKNRPDKHPGQVTS

SEQ ID NO: 304 - protein, 160 aa, Arabidopsis thaliana [sequence omitted]

SEQ ID NO: 305 - protein, 159 aa, Arabidopsis thaliana
MAEQTEKAFLKQPKVFLSSKISGKGKRPGKGGNRFWKNIGLGFKTPREAIDGAYIDSKCPFTGTVSIRGRILAGTCHSAKMQRTIIVRRDYLHFVKKYPRYEKRHSHIPAHVSPCFRVKEGDHVIIGQCRPLSKTVRFNVLKVIPTGASAFGKKALTGV

SEQ ID NO: 306 - protein, 149 aa, Zea mays
MSRRKTREPKEENVLGPTVREGEFVFGVAHIFASFNDTFIHVTDLSGRETLVRITGGMKVKADRDESSPYAAMLAAQDVAQRCKELGITALHIKLRATGGNKTKTPGPGAQSALRALARSGMKIGRIEDVTPVPTDSTRRKGGRRGRRL

SEQ ID NO: 307 - protein, 136 aa, Saccharomyces cerevisiae
SNVVQARDNSQVFGVARIYASFNDTFVHVTDLSGKETIARVTGGMKVKADRDESSPYAAMLAAQDVAAKCREVGITAVHVKIRATGGTRTKTPGPGGQAALRALARSGLRIGRIEDVTPVPSDSTRKKGGRRGRRL

SEQ ID NO: 308 - protein, 150 aa, Zea mays
MSGRKKTREPKEENVLGPAVREGEHVFGVAHIFASFNDTFIHVTDLSGRETLVRITGGMKVKADRDESSPYAAMLASQDVAQRCKELGITALHIKLRATGGNKTKTPGPGAQSALRALARSGMKIGRIEDVTPVPTDSTRRKGGRRGRRL

SEQ ID NO: 309 - protein, 137 aa, Saccharomyces cerevisiae
ANDLVQARDNSQVFGVARIYASFNDTFVHVTDLSGKETIARVTGGMKVKADRDESSPYAAMLAAQDVAAKCKEVGITAVHVKIRATGGTRTKTPGPGGQAALRALARSGLRIGRIEDVTPVPSDSTRKKGGRRGRRL

SEQ ID NO: 310 - protein, 138 aa, Saccharomyces cerevisiae
MSTDSIVKASNWRLVEVGRVVLIKKGQSAGKLAAIVEIIDQKKVLIDGPKAGVPRQAINLGQVVLTPLTFALPRGARTATVSKKWAAAAVCEKWAASSWAKKIAQRERRAALTDFERFQVMVLRKQKRYTVKKALAKA

SEQ ID NO: 311 - protein, 138 aa, Saccharomyces cerevisiae
MSTDSIVKASNWRLVEVGRVVLIKKGQSAGKLAAIVEIIDQKKVLIDGPKAGVPRQAINLGQVVLTPLTFALPRGARTATVSKKWAAAGVCEKWAASSWAKKIAQRERRAALTDFERFQVMVLRKQKRYTVKKALAKA

SEQ ID NO: 312 - protein, 80 aa, Methanococcus jannaschii
MPAIEVGRVCIKTAGREAGKVCVIVDILDKNFVIVDGLVKRRRCNIKHLEPTEKKVDIPKGASTEEVKLALDAAGLLKEE

SEQ ID NO: 313 - protein, 165 aa, Methanobacterium thermoautotrophicum
MMYRYVKDAWKNPKDSYVRELMWERAPKWRRDPVIKRIERPTRIDRARALGYRAKPGYIVVRTRVRRGSQRKTRFKAGRRPTRMGVKKITTAKSIKRIAEERVARKYPNMEVLNSYWVWEDGKYKFYEVILVDPNHLAIKNDPKIYWICVKQHRGRVFRGLISEG

SEQ ID NO: 314 - protein, 175 aa, Saccharomyces cerevisiae
SAQKAPKWYPSEDVAALKKTRKAARPQKLRASLVPGTVLILLAGRFRGKRVVYLKHLEDNTLLISGPFKVNGVPLRRVNARYVIATSTKVSVEGVNVEKFNVEYFAKEKLTKKEKKEANLFPEQQNKEIKAERVEDQKVVDKALIAEIKKTPLLKQYLSASFSLKNGDKPHMLKF

SEQ ID NO: 315 - protein, 175 aa, Saccharomyces cerevisiae
TAQQAPKWYPSEDVAAPKKTRKAVRPQKLRASLVPGTVLILLAGRFRGKRVVYLKHLEDNTLLVTGPFKVNGVPLRRVNARYVIATSTKVSVEGVNVEKFNVEYFAKEKLTKKEKKEANLFPEQQTKEIKTERVEDQKVVDKALLAEIKKTPLLKQYLSASFSLKNGDKPHLLKF

SEQ ID NO: 316 - protein, 170 aa, Hordeum vulgare
MVKYSTDPANPTKSAKAMGRDLRVHFKNTRETAFALRKMPLNKAKRYLEDVLAHKQAIPFRRYCRGVGRTAQVKNRQPNGQGRWPAKSAKFVLDLLKNAESNAEVKGLDVDALYISHIQVNQAQKQRRRTYRAHGRINPYMSNPCHIELILSEKEEPVKKEAESHIARKA

SEQ ID NO: 317 - protein, 172 aa, Hordeum vulgare
MVKYSRDPSNPTKSAKACGKDLRVHFKNTRETAFALRRMPLGKAKRYLEDVLAHKQAIPFRRYCRGVGRTAQVKNRQPNGQGRWPAKSAQFVLDLLKNAESNAEVKGLDVDNLYISHIQVNQAQKQRRRTYRAHGRINPYMSNPCHIELILSEKEEPVKKEADNVVAPRKAI

SEQ ID NO: 318 - protein, 136 aa, Saccharomyces cerevisiae
MGRVRTKTVKRASKALIERYYPKLTLDFQTNKRLCDEIATIQSKRLRNKIAGYTTHLMKRIQKGPVRGISFKLQEEERERKDQYVPEVSALDLSRSNGVLNVDNQTSDLVKSLGLKLPLSVINVSAQRDRRYRKRV

SEQ ID NO: 319 - protein, 136 aa, Saccharomyces cerevisiae
MGRVRTKTVKRASKALIERYYPKLTLDFQTNKRLCDEIATIQSKRLRNKIAGYTTHLMKRIQKGPVRGISFKLQEEERERKDQYVPEVSALDLSRSNGVLNVDNQTSDLVKSLGLKLPLSVINVSAQRDRRYRKRN

SEQ ID NO: 320 - protein, 63 aa, Methanococcus jannaschii
MMGRIRQTLIKRTAMELIKKYRDLFTTDFETNKRVLEEVAQISTKRLRNRIAGYITHKMRQLQ

SEQ ID NO: 321 - protein, 121 aa, Methanococcus jannaschii
MAKKITATNPRLVKLIEILKQESYKNQAKIWKDIARRLAKPRRRRAEVNLSKINRYTKEGDVVLVPGKVLGAGKLEHKVVVAAFAFSETAKKLIKEAGGEAITIEELIKRNPKGSNVKIMA

SEQ ID NO: 322 - protein, 118 aa, Sulfolobus acidocaldarius
MSRGSTNIMLRKLITSLKKQDKAIWVRVAEELEAPRRKRAYINIYKINRYSKANDIIVVPGKVLGVGNLDHPVTVVALSFSKPAKEKILRSGGKVMSLYKAIQELNDFKGKTVRLMKQ

SEQ ID NO: 323 - protein, 119 aa, Sulfolobus solfataricus
MKVTGSTNITVRKLIRNLEKSKKPLWRKVAEELSIPSRKRPYINLYKINEHTKPNDIVVVPGKVLGIGKLDHEVTVIALDFSKSAIEKIRASGGQAMSIYKALETFKDFKGRSVRLMKQ

SEQ ID NO: 324 - protein, 143 aa, Saccharomyces cerevisiae
PGVSVRDVAAQDFINAYASFLQRQGKLEVPGYVDIVKTSSGNEMPPQDAEGWFYKRAASVARHIYMRKQVGVGKLNKLYGGAKSRGVRPYKHIDASGSINRKVLQALEKIGIVEISPKGGRRISENGQRDLDRIAAQTLEEDE

SEQ ID NO: 325 - protein, 143 aa, Saccharomyces cerevisiae
AGVSVRDVAAQDFINAYASFLQRQGKLEVPGYVDIVKTSSGNEMPPQDAEGWFYKRAASVARHIYMRKQVGVGKLNKLYGGAKSRGVRPYKHIDASGSINRKVLQALEKIGIVEISPKGGRRISENGQRDLDRIAAQTLEEDE

SEQ ID NO: 326 - protein, 148 aa, Methanococcus jannaschii
MVTVYDVPADKLIQKTAEKLKEMNIGVPEWVDFVKTGVSRERRPDQDDWWYIRCASILRKIYIYGPVGVSRLRTAYGGRKNRGHEPEHFYKGSGNIIRKALQELEKLGLVEKTPEGRVVTPKGRSFLDNIAKEVRDEIINEIPALAKY

SEQ ID NO: 327 - protein, 145 aa, Methanobacterium thermoautotrophicum
MTTVYDVPADLLINRVAEELKNDSKVKSPEWVNFVKTGVHKERRPENPDWWYVRAAALLRRVYIDGPVGVNSLRTHYGGKKDRGSRPEKFRRGSGAIIRRALQQLEESGLIKREENGRVITPEGRSFLDKAAAEVKKEVEGLERY

SEQ ID NO: 328 - protein, 148 aa, Ascaris suum
MVKATSVKDVDQHEIVQHIAKFLKKSGKVKVPEWSDVTKMGISKELAPLNSDWYYVRTASIARRLYVRSPTGVDALRLVYGGSKRRGVVPNHFAKASGSVIRKALQTLEAIKWVQKHPDGNGRVLTKQGRKDLDRIASQMRQNDRFTA

SEQ ID NO: 329 - protein, 150 aa, Ascaris suum
MVKQPSVKDVDQHEIVRYIAGFLKKSGKVKVPEWSDLVKLGITKELAPVDSDWYYVRTASVARRLYIRSPTGVGALRRVYGGNKRRGVTPNHFARASGSVIRKALQTLEAIKWVEKHPDGNGRILTKQGRKDLDRIASQMRQNTKITLEP

SEQ ID NO: 330 - protein, 160 aa, Saccharomyces cerevisiae
MGKSHGYRSRTRYMFQRDFRKHGAVHLSTYLKVYKVGDIVDIKANGSIQKGMPHKFYQGKTGVVYNVTKSSVGVIINKMVGNRYLEKRLNLRVEHIKHSKCRQEFLERVKANAAKRAEAKAQGVAVQLKRQPAQPRESRIVSTEGNVPQTLAPVPYETFI

SEQ ID NO: 331 - protein, 160 aa, Saccharomyces cerevisiae
MGKSHGYRSRTRYMFQRDFRKHGAVHMSTYLKIYKVGDIVDIKANGSIQKGMPHKFYQGKTGVVYNVTKSSVGVIINKMVGNRYLEKRLNLRVEHIKHSKCRQEFLERVKANAAKRAEAKAQGVAVQLKRQPAQPRESRIVSTEGNVPQTLAPVPYETFI

SEQ ID NO: 332 - protein, 70 aa, Methanococcus jannaschii
MPEWRTCSFCGYEIEPGKGKMVVEKDGTVLYFCSSKCEKSYRMGRNPRKLKWTKVYQDMKAELKKAQESQ

SEQ ID NO: 333 - protein, 119 aa, Saccharomyces cerevisiae
MPKKRASNGRNKKGRGHVKPVRCVNCSKSIPKDKAIKRMAIRNIVEAAAVRDLSEASVYPEYALPKTYNKLHYCVSCAIHARIVRVRSREDRKNRAPPQRPRFNRENKVSPADAAKKAL

SEQ ID NO: 334 - protein, 119 aa, Saccharomyces cerevisiae
MPKKRASNGRNKKGRGHVKPVRCVNCSKSIPKDKAIKRMAIRNIVEAAAVRDLSEASVYPEYALPKTYNKLHYCVSCAIHARIVRVRSREDRKNRAPPQRPRFNRDNKVSPAAAAKKAL

SEQ ID NO: 335 - protein, 82 aa, Saccharomyces cerevisiae
MVLVQDLLHPTAASEARKHKLKTLVQGPRSYFLDVKCPGCLNITTVFSHAQTAVTCESCSTILCTPTGGKAKLSEGTSFRRK

SEQ ID NO: 336 - protein, 82 aa, Saccharomyces cerevisiae
MVLVQDLLHPTAASEARKHKLKTLVQGPRSYFLDVKCPGCLNITTVFSHAQTAVTCESCSTVLCTPTGGKAKLSEGTSFRRK

SEQ ID NO: 337 - protein, 81 aa, Arabidopsis thaliana
AKKRKKKTYTKPKKIKHKHKKVKLAVLQFYKIDGSGKVQRLRKECPNATCGAGTFMASHFDRHYCGKCGLTYVYQKEGVEA

SEQ ID NO: 338 - protein, 78 aa, Asparagus officinalis
AKKRKKKTYTKPKKIKHKKKKVKLAVLQFYKVDDTGKVIRLRKECPNAECGAGTFMANHKDRHYCGKCGLTYVYQKGE

SEQ ID NO: 339 - protein, 93 aa, Caenorhabditis briggsae
AKKRKKKVYTTPKKNKRKPKKVKLAVLKYYKVDENGKITRLRKECQQPSCGGGVFMAQHANRHYCGRCHDTLVVDTATAAATSGEKGGKKGKK

SEQ ID NO: 340 - protein, 93 aa, Caenorhabditis elegans
AKKRKKKVYTTPKKNKRKPKKVKLAVLKYYKIDENGKITRLRKECQQPSCGGGVFMAQHANRHYCGRCHDTLVVDTATAAATSGEKGGKKGKK

SEQ ID NO: 341 - protein, 78 aa, Dictyostelium discoideum
GGKKKKKKTYATPKVLKRKLRKVKLAVLKYYKFDENGKIKRVLRECPAETCGAGVFMAQHANRQYCGKCHSTLVKKSK

SEQ ID NO: 342 - protein, 80 aa, Drosophila melanogaster
AKKRKKKNYSTPKKIKHKRKKVKLAVLKYYKVDENGKIHRLRRECPGENCGAGVFMAAHEDRHYCGKCNLTFVFSKPEEK

SEQ ID NO: 343 - protein, 79 aa, Hordeum vulgare
AKKRKKKTYTKPKKQKHKHKKVKLAVLQFYKVDDATGKVTRLRKECPNADCGAGTFMANHFDRHYCGKCGLTYVYNQKA

SEQ ID NO: 344 - protein, 80 aa, Homo sapiens [sequence omitted]

SEQ ID NO: 345 - protein, 79 aa, Lupinus albus
AKKRKKKTYTKPKKIKHKHKKVKLAVLQFYKVDDSGKVQRLRKECPNTECGAGTFMANHFDRHYCGKCGKTYVYQKADA

SEQ ID NO: 346 - protein, 80 aa, Lycopersicon esculentum
AKKRKKKTYTKPKKIKHKKKKVKLAVLQFYKVDDTGKVQRLRKECPNAECGAGTFMANHFDRHYCGKCGLTYVYNKAGGD

SEQ ID NO: 347 - protein, 79 aa, Zea mays
AKKRKKKTYTKPKKIKHKHKKVKLAVLQFYKVDDATGKVTRLRKECPNTECGAGVFMANHFDRHYCGKCGLTYVYNQKA

SEQ ID NO: 348 - protein, 79 aa, Manduca sexta
AKKRKKKNYSTPKKIKHKKKKVKLAVLRFYKVDENGKIHRLRRECTGEQCGAGVFMAVMEDRHYCGKCHSTMVFKDDDK

SEQ ID NO: 349 - protein, 60 aa, Methanococcus jannaschii
MTKGKKTAKYKYYKIEGDKVIRLKKTCPRCGPGVFMAEHLNRYACGKCGYMEWKQPQKKE

SEQ ID NO: 350 - protein, 51 aa, Methanobacterium thermoautotrophicum
MKKFELYEVKDGKLVRKNPFCVRCSNGVFMADHGDRYACGKCGYTEWKNRE

SEQ ID NO: 351 - protein, 78 aa, Neurospora crassa
GKKRKKKVYTTPKKIKHKRKKTKLAVLKYYKVDSDGKIDRLRRECPNETCGAGVFMAAMQDRQYCGRCHLTYVFEKSS

SEQ ID NO: 352 - protein, 79 aa, Oryza sativa
AKKRKKKTYTKPKKIKHKHKKVKLAVLQFYKVDDATGKVTRLRKECPNHDCGAGTFMANHFDRHYCRKCRLTYVYNQKA

SEQ ID NO: 353 - protein, 80 aa, Rattus norvegicus
AKKRKKKSYTTPKKNKHKRKKVKLAVLKYYKVDENGKISRLRRECPSDECGAGVFMGSHFDRHYCGKCCLTYCFNKPEDK

SEQ ID NO: 354 - protein, 148 aa, Saccharomyces cerevisiae
PSRFTKTRKHRGHVSAGKGRIGKHRKHPGGRGMAGGEHHHRINMDKYHPGYFGKVGMRYFHKQQAHFWKPVLNLDKLWTLIPEDKRDQYLKSASKETAPVIDTLAAGYGKILGKGRIPNVPVIVKARFVSKLAEEKIRAAGGVVELIA

SEQ ID NO: 355 - protein, 55 aa, Saccharomyces cerevisiae
AHENVWFSHPRRYGKGSRQCRVCSSHTGLIRKYGLNICRQCFREKANDIGFNKFR

SEQ ID NO: 356 - protein, 55 aa, Saccharomyces cerevisiae
AHENVWFSHPRRFGKGSRQCRVCSSHTGLVRKYDLNICRQCFREKANDIGFHKYR

SEQ ID NO: 357 - protein, 124 aa, Caenorhabditis elegans
MADTAVARRPSAPTTGRLYVKAIFTGFKRGLRTQSEHTSLLKLEGVFNKEDAGFYAGKRVVYLYKAHNKTLKTGHTVATRTRAIWGKITRPHGNAGAVRAKFHHNIPPSALGKRIRVLLYPSNI

SEQ ID NO: 358 - protein, 110 aa, Homo sapiens [sequence omitted]

SEQ ID NO: 359 - protein, 87 aa, Pyrococcus woesei
MSIKGVVLSYRRSKENQHNNVMIIKPLDVNSREEASKLIGRLVLWKSPSGKILKGKIVRVHGTKGAVRARFEKGLPGQALGDYVEIV

SEQ ID NO: 360 - protein, 110 aa, Rattus norvegicus
MSGRLWCKAIFAGYKRGLRNQREHTALLKIEGVYARDETEFYLGKRCAYVYKAKNNTVTPGGKPNKTRVIWGKVTRAHGNSGMVRAKFRSNLPAKAIGHRIRVMLYPSRI

SEQ ID NO: 361 - protein, 110 aa, Xenopus laevis
MSGRLWCKATFAGYKRGLRNQREHTALLKIEGVYARDETEFYFGKRCAYVYKAKNNTVTPGGKPNRTRVIWGKVTRAHGNSGMVRAKFRSNLPAKAIGHRIRVMLYPSRI

SEQ ID NO: 362 - protein, 106 aa, Saccharomyces cerevisiae
AESHRLYVKGKHLSYQRSKRVNNPNVSLIKIEGVATPQDAQFYLGKRIAYVYRASKEVRGSKIRVMWGKVTRTHGNSGVVRATFRNNLPAKTFGASVRIFLYPSNI

SEQ ID NO: 363 - protein, 106 aa, Saccharomyces cerevisiae
AESHRLYVKGKHLSYQRSKRVNNPNVSLIKIEGVATPQEAQFYLGKRIAYVYRASKEVRGSKIRVMWGKVTRTHGNSGVVRATFRNNLPAKTFGASVRIFLYPSNI

SEQ ID NO: 364 - protein, 92 aa, Brassica rapa
AKRTKKVGIVGKYGTRYGASIRKQIKKMEVSQHSKYFCEFCGKYGVKRKAVGIWGCKDCGKVKAGGAYTMNTASAVTVRSHTIRRLREQIEG

SEQ ID NO: 365 - protein, 91 aa, Gallus gallus
AKRTKKVGIVGKYGTRYGASLRKMVKKIEISQHAKYTCSFCGKTKMKRKAVGIWHCGSCMKTVAGGAWTYNTTSAVTVKSAIRRLKELKDQ

SEQ ID NO: 366 - protein, 91 aa, Homo sapiens [sequence omitted]

SEQ ID NO: 367 - protein, 92 aa, Methanococcus jannaschii
MFSHTKKVGPTGRFGPRYGLKIRVRVRDVEIKAKKKYKCPVCGFPKLKRASTSIWVCGKCGAKIAGGAYTPETGAGKAVMKAIRRIVERKEE

SEQ ID NO: 368 - protein, 89 aa, Methanobacterium thermoautotrophicum
MARTKKVGITGRFGPRYGRKAKRAVKKIEEEMKRKHVCPSCDRPGVKRESRGIWKCRKCGAVFTGGAYLPVTPMGKTAARNIKRIVGGK

SEQ ID NO: 369 - protein, 91 aa, Saccharomyces cerevisiae
AKRTKKVGITGKYGVRYGSSLRRQVKKLEIQQHARYDCSFCGKKTVKRGAAGIWTCSCCKKTVAGGAYTVSTAAAATVRSTIRRLREMVEA

SEQ ID NO: 370 - protein, 106 aa, Candida maltosa
MVNVPKTRKTYCKGRECRKHSQHKVTQYKAGKSSLFAQGKRRYDRKQSGFGGQTKPVFHKKAKTTKKVVLRLECVVCKTKAQLALKRCKHFELGGDKKQKGQALQF

SEQ ID NO: 371 - protein, 105 aa, Candida maltosa
VNIPKTRNTYCKGKGCRKHTIHKVTQYKSGRASLFAQGKRRYDRKQSGYGGQTKQVFHKKAKTTKKIVLKLECTVCKTKKQLPLKRCKHIELGGEKKQKGQALQF

SEQ ID NO: 372 - protein, 142 aa, Saccharomyces cerevisiae
SAVPSVQTFGKKKSATAVAHVKAGKGLIKVNGSPITLVEPEILRFKVYEPLLLVGLDKFSNIDIRVRVTGGGHVSQVYAIRQAIAKGLVAYHQKYVDEQSKNELKKAFTSYDRTLLIADSRRPEPKKFGGKGARSRFQKSYR

SEQ ID NO: 373 - protein, 87 aa, Saccharomyces cerevisiae
GKGTPSFGKRHNKSHTLCNRCGRRSFHVQKKTCSSCGYPAAKTRSYNWGAKAKRRHTTGTGRMRYLKHVSRRFKNGFQTGSASKASA

SEQ ID NO: 374 - protein, 87 aa, Saccharomyces cerevisiae
GKGTPSFGKRHNKSHTLCNRCGRRSFHVQKKTCSSCGYPSAKTRSHNWAAKAKRRHTTGTGRMRYLKHVSRRFKNGFQTGSAKATSA

SEQ ID NO: 375 - protein, 141 aa, Cyanophora paradoxa
MAKKVIAIIKIVLPAGKATPAPPVGPALGPYGVSSVNFCKEYNAKTADKGGLVIPAEITVYDDRSYSFVLKTPPASVLIAKAASVEKGSGEPNRKKVGSITKAQLEQIAKVKFPDLNTQNLEAASRIVEGTARNMGITITD

SEQ ID NO: 376 - protein, 141 aa, Odontella sinensis
MAKKITALIKLALPAGKATPAPPVGPALGQHGVNIAAFCKEYNAKTTDKTGLIIPVEISVYEDRSYTFILKTPPASVLLANAAKIKKGSSTPNRVNVGSITKSQLEEIASIKLPDLNTTKISSAMKIVEGTARNMGISIVD

SEQ ID NO: 377 - protein, 141 aa, Porphyra purpurea
MAKKVTGIVKLALNAGKATPAPPVGPALGQHGVNIVMFCKEYNARTADKTGLVIPVEISVYEDRSFSFILKTPPASVLIVKAAGLNKGSGEPNIKKIGSITTKQLESIAETKLPDLNTNNLSQAMKIVGGTAKNMGILIED

SEQ ID NO: 378 - protein, 139 aa, Odontella sinensis
MNETFIPASDYKKKNWCLIDCKDQKLGRIAVVISRLLSGKQKLHYHPAFDVGDYVVVINAQDMIFDSQQPRFSVNVPGRPGRLLKQVINALPSQLLMTAIYGMLPEGSAKKSLPKRLKIYNGPDHPHAAQNPIKLDEFI

SEQ ID NO: 379 - protein, 142 aa, Porphyra purpurea
MNKTQVPSLITSQSWYVIDAKNQKLGRMSTHISNILRGKNKPSYTPYLDTGDYVIVINSSEVSVSGNKTTQKLYRRHSGQPGGLKVETFEQLQTRLPNRIVEKSVKGMLPKGPLGRKLFTKLKVYPGPSHPHAAQKPQEYMV

SEQ ID NO: 380 - protein, 122 aa, Chlamydomonas reinhardtii
MIKPLSYLNVADNSGARELMCIRALGGSYRESANIGDVIIAVVKDALPNMPVKRSDIVRAVIVRTRKGIRRENGMAIRFDDNAAVIINKEGNPRGTRVFGPIARELRDKNFTKIVSLAPEVL

SEQ ID NO: 381 - protein, 122 aa, Chlorella vulgaris
MIQPQTYLRVADNTGARELMCIRVLGGGKQRAATVGDIIIAVVKDATPNMPVKRSDIVRAVIVRTRKNVRRVNGTSIRFDENAAVIINKENNPRGTRVFGPVARELRDGNFTKIISLAPEVL

SEQ ID NO: 382 - protein, 122 aa, Cyanophora paradoxa
MIQPQSYLTAADNSGARKLMCIRVLGGGNRRYARIGDVIVAVVKDGIPNIPIKKSDTVKAVIVRTRKELKRDNGMNICFDDNAAVIINADGNPRGTRVFGPVARELRDKNFTKIISLAPEVL

SEQ ID NO: 383 - protein, 121 aa, Euglena gracilis
MIKPQTYLKIADNTGAQKIMCIRILGPNCQYANIGDIIIAVVKEAIPNMVVKKSDIVKAVIVRTVKGVRRESGMAIRFDENAAVIINNDRSPKGTRIFGPIARELREKEFVKIMSLAPEVV

SEQ ID NO: 384 - protein, 123 aa, Zea mays
MIQPQTLLNVADNSGARKLMCIRVIGAAGNQRYARIGDVIIAVIKDAVPQMPLERSEVIRAVIVRTRKEFKGDDGIIIRYDDNAAVIIDQKGNPKGTRVFGAVAEELRELNLTKIVSLAPEVL

SEQ ID NO: 385 - protein, 122 aa, Marchantia polymorpha
MIQPQTYLNVADNSGARKLMCIRVIGTSNRKYANIGDIIIAVVKEAVPNMPIKKSEIVRAVIVRTCKEFKRNNGSIIKFDDNAAVVINQEGNPKGTRVFGPIARELRESNFTKIVSLAPEVL

SEQ ID NO: 386 - protein, 121 aa, Odontella sinensis
MIYPQTMLTVADNTGARKIMCIRVLGGNRKYAKIGDTIIGVVKEAIPNMPIKRSDIVRAIVVRTSKTIRRPDGMYIRFDDNAAVIVNLDNNPRGTRVFGPVAREIRDKNFSKIVSLAPEVL

SEQ ID NO: 387 - protein, 74 aa, Oenothera ammophila
MIQPQTRLNVADNSGARELMCIRIIGASNRRYAHIGDIIVARRNPKGTRVFGAIAHELRELSFTKIVSLAPEVL

SEQ ID NO: 388 - protein, 123 aa, Oryza sativa
MIQPQTLLNVADNSGARKLMCIRVIGAASNQRYARIGDVIVAVIKDAVPQMPLERSEVIRAVIVRTCKEFKCEDGIIIRYDDNAAVIIDQKGNPKGTRVFGAIAEELRELNFTKIVSLAPEVL

SEQ ID NO: 389 - protein, 122 aa, Pinus thunbergii
MIQSQTYLNIADNSGARKIMCIRVLGASNRKCAHIGDVIIAIIKEAVPNMPLEKSEVVRAVVIRTCKEFERDNGMMIRSDDNAAVVIDQEGNPKGTRVFGPVAQELRQLNFTKIVSLAPEVL

SEQ ID NO: 390 - protein, 122 aa, Porphyra purpurea
MIQTQSYLNVADNSGARKIMCIRVLGTSNPSYASIGDVIIGVVKDASPNMPVKRSDVVRAVVVRTRKALRRNDGMSIRFDDNAAVIINQDNNPRGTRVFGPIARELRDKNFSKIISLAPEVV

SEQ ID NO: 391 - protein, 122 aa, Spinacia oleracea
MIQPQTHLNVADNSGARELMCIRIIGASNRRYARIGDVIVAVIKEAIPNTPLERSEVIRAVVVRTCKELKRDNGMIIRYDDNAAVVIIDQEGNPKGTRIFGAIARELRQKFAKIVSLAPEVL

SEQ ID NO: 392 - protein, 123 aa, Nicotiana tabacum
MIQPQTHLNVADNSGARELMCIRIIGASNRRYAHIGDVIVAVIKEAVPNMPLERSEVVRAVIVRTCKELKRDNGMIIRYDDNAAVVIDQEGRKSKGTRIFGAIARELRELNFTKIVSLAPEVL

SEQ ID NO: 393 - protein, 136 aa, Chlamydomonas reinhardtii
MLSPKRTKFRKPHRGHLRGKATRGNKIVFGDFALQAQEPCWITSRQIEAGRRVLTRYVRRGGKLWIRIFPDKAVTMRPAGTRMGSGKGAPDYWVAVVHPGKILYEMQGVSETIARQAMRIAAYKMPVKTKFLTKTV

SEQ ID NO: 394 - protein, 136 aa, Chlamydomonas sp. (strain WXM)
MLSPKRTKFRKPHRGHLRGKATRGNTIVFGDFALQAQEPCWITSRQIEAGRRVLTRYVRRGGKLWIRIFPDKAVTMRPAGTRMGSGKGAPDYWVAVVHPGKILYEMQGVSETIARQAMRIAAYKMPVKTKFLTKQA

SEQ ID NO: 395 - protein, 134 aa, Chlorella vulgaris
MLSPKRTKYRKHHRGRMRGKASRGNTVVFGDYALQSLEASWITSRQIEAARRAMTRQVRRGGQIWIRLFPDKPVTMRPAETRMGSGKGAPEFWVAVVRPGKVLYELKGVPESVARVALRLAASKLPVKTQILVK

SEQ ID NO: 396 - protein, 136 aa, Cyanophora paradoxa
MLSPRRTKFRKQQRGRMKGISTRGNNLVFGDFGLQALEPAWITSRQIEASRRAINRYVRRGGKIWIRIFPDKPVTMRPAETRMGSGKGAPEYWVAIVKPGRVIFEINGVSQEMAKAAFRIATFKLPIKTKFISSRV

SEQ ID NO: 397 - protein, 135 aa, Epifagus virginiana
MLSPQKTRFRKQHRGRMKGISYRGNNICFGKYGLKALEPAWITPRQIEAGRRAITRKFRRGGKIWVRVFPDKPVTVRSSETRMGSGKGSHKYFVAVVKPGLILYEIGGVTENIAKRAILIAASKMPMQTQFIISG

SEQ ID NO: 398 - protein, 135 aa, Euglena gracilis
MLSPKRTKFRKYHRGRLTGKIYLIDKVVFGNYALQSLEPGWITSRQIEAARRVITRYAKRGGKLWIRIFPDKPVTFRAAETRMGSRKGNVEYWVAIVKPGKILYEVLGISESIAKYSLKIAGYKMPIKTRVIVKI

SEQ ID NO: 399 - protein, 135 aa, Gracilaria tenuistipitata
MLSPKRTKFRKQHRNRMNGKASKGNTIAFGEYALQTLEPVWLTARQIEATRRTITRYVKRGGKIWIRVFPDKPITARPAETRMGSGKGATEYWVAVIKPGHILFEIAGVSKQTAQEAMKLASYKLPIKTKFITKQ

SEQ ID NO: 400 - protein, 136 aa, Zea mays
MLSPKRTRFRKQHRGRMKGKSCRGNHICFGRYALQVLEPAWITARQIEAGRRAMTRYARRGGKIWVRIFPDKPVTIRPTETRMGSGKGSPEYWVAVVKPGRILYEMSGVSETVARAAISIAASKMPIRSQFLRLEI

SEQ ID NO: 401 - protein, 143 aa, Marchantia polymorpha
MLSPKRTKFRKQHCGNLKGISTRGNVICFGKFPLQALEPSWITSRQIEAGRRAITRYARRGGKLWIRIFPDKPITIRPAETRMGSGKGSPEYWVAVVKPGKILYEISGVSENIARAAMKIAAYKMPIRTQFITTSSLNKKQEI

SEQ ID NO: 402 - protein, 137 aa, Odontella sinensis
MLSPKRTKYRKYHRGRMRGKATRGNEVTFGDYGLQALEPTWITSRQIEAARRTITRYTKRGAALWIRIFPDKTVTARAAESRMGSGKGAVDYWVAVVKPGTILFEIASVPEEIAATALHLASYKLPIKTKFITRIKI

SEQ ID NO: 403 - protein, 136 aa, Oryza sativa
MLSPKRTRFRKQHRGRMKGKSYRGNCICFGRYALQALEPTWITARQIEAGRRAMTRYARRGGKIWVRIFPDKPVTIRPTETRMGSGKGSPEYWVAVVKPGRILYEMGGVSETVARRAISIAASKMPIRSQFLRLEI

SEQ ID NO: 404 - protein, 134 aa, Pinus thunbergii
MLSPKRTKFRKQHRGRMKGVSYRGNRICFGRFALQALEPAWITSGQIEAGRRTINRYARRGGKIWVRIFPDKPITMRPAETRMGSGKGSPEYWVSVIRPGRILYEMGGVSETVARAAARIAAYKMPIRTQFVTT

SEQ ID NO: 405 - protein, 139 aa, Porphyra purpurea
MLSPKKTKFRKQHRGRMKGSASKGNTIAFGDYALQATEPVWLTSRQIEATRRTITRYVRRGGKLWIRVFPDKPVTARPAETRMGSGKGAPEYWVAVIKPGHILFEITGVPQKTAQQAMKLASYKLPIKTKFIVRNTIES

SEQ ID NO: 406 - protein, 135 aa, Spirodela oligorhiza
MLSPKRTRFRKQHRGRMKGKSYRGNHISFGRYALQAVEPAWITARQIEAGRRAISRYARRGGKIWVRLFPDKRVTLRPAETRMGSGKGSPEYWVSVVKPGRILYEIGGVSETVARTAMLLAASKMPIRTQFIIEE

SEQ ID NO: 407 - protein, 135 aa, Spinacia oleracea
MLSPKRTRFRKQHRGRMKGISYRGNRICFGRYALQALEPAWITSRQIEAGRRAMTRNGRRGGKIWVRIFPDKPVTVRPAETRMGSGKGSPEYWVAVVKPGRILYEISGVAENIARRDVAIAASKMPIRTQFIISG

SEQ ID NO: 408 - protein, 134 aa, Nicotiana tabacum
MLSPKRTRFRKQHRGRMKGISHRGNHISFGKYALQALEPAWITSRQIEAGRRAMTRNARRGGKIWVRIFPDKPVTLRPAETRMGSGKGSPEYWVAVVKPGRILYEMGGVTENIARRAISLAASKMPIRTQFIIS

SEQ ID NO: 409 - protein, 121 aa, Cyanophora paradoxa
MKLTRKQATQRRHRRVRRKVFGTSERPRLAVFRSHQHIYAQIIDDTQHRTLAASSTLEPSVKNSELSSTSTCAASAIVGQLIAKKALEKGITQVVFDRGGKIYHGRVRTLAEAAREAGLQF

SEQ ID NO: 410 - protein, 135 aa, Odontella sinensis
MKFSKRVLLKLKNKNKKLKPNKYKQLKRESLRGLIKGTPERPRLSVFRSNENIYAQIIDDTNSKTLVSCSTLDRDIKLNIQNGRTCDASKLIGQKLAKLSLKKNITKIVFDRGPYLYHGRIKALADGAREGGLQF

SEQ ID NO: 411 - protein, 145 aa, Pisum sativum
MALLCFNSFTTTPVTSSSSLFPHPTANPISRVRIGLPTNCLKGFRILTPIVQKPRKNSIFIASAAAGADSNVADGVEESESKKESDVVSVDKLPLESKLKEREERMLKMKLAKKIRLKRKRLVQKRRLRKKGNWPPSKMKKLEGV

SEQ ID NO: 412 - protein, 120 aa, Porphyra purpurea
MKINSKQTRIHKHRRVRKKVQGTASRPRLCVFRSNKHIYAQVIDDIKGITLVAASSINLKLQSSITLGSNCEASRSVGKTLAERSIKEGIENVVFDRGGKLYHGRVEALAEAAKEAGMVF

SEQ ID NO: 413 - protein, 130 aa, Chlorella vulgaris
MAKLQQLVQAIQSGTIKTELPDVRVGDLVRIGVSIQEGNKQRIQPFEGTVISKHQAGANSTVTVRKSLQGIGVERVFPLYAPCVANLQVLRRAQVSRAKLYYLRSRTGKATRLKEKFETLPQIWMNQNQH

SEQ ID NO: 414 - protein, 131 aa, Cyanophora paradoxa
MHTQQLISQIESQYLKDNLPEICVGDTVKVGVLIQEEDNKNSGEKERIQFYEGVVISLSKLKNINGTIRVRRILQGIGIERTFLVHSPLIKSINIIRRSKVRRAKLYYLRTLTGKATRLKQRLIKHYRLIY

SEQ ID NO: 415 - protein, 120 aa, Odontella sinensis
MLSLNTQKTIDNLHNVFTKKNIPPIRIGDNVKVGVRIIEGNKERVQFYEGTVIAKKNSSINTTLTVRKVLQGIGVERIFLIHSPKVDSIEVLRSSKVRRSKLYYLRNLKGKASRLKQQFR

SEQ ID NO: 416 - protein, 123 aa, Porphyra purpurea
MKDNNIKLSLLMKSVEQPLMKTELPEIKVGDTIRLGLLVKEGSKTREQLCEGVVLSRKKRKSLNTSLTLRCSFQGVGVERVFFLNSPRVTFVKVIRRAKVRRAKLYYLRDLLGKASRLKQIFN

SEQ ID NO: 417 - protein, 117 aa, Astasia longa
MIRIKDNFKNYKKHKKILKLSKGFIGSNSKIFKISNQKIMKALYFSFSDRKKKKRSNKKIWINRINYFLKNYFFNNFNYNKIINKIKLNKICINKKILSEIIINDYKTIYKLKNMLT

SEQ ID NO: 418 - protein, 111 aa, Chlamydomonas reinhardtii
TRVKRGNVSRKRHKKILNMSKGFRGAASTLFRTANQQNMKALRYSYRNRRQKKRDFRRMWITRVNSAVRRYGLNYSEFMNYLKTHKIQLNRKVIAQLSICDPEAFMQLLLF

SEQ ID NO: 419 - protein, 114 aa, Chlorella vulgaris
TRVKRGNVARKRRKQVLNLASGFRGSSSRLFRTAQQQTMKALSYSYRDRQQKKREFCGLWVTRLNAAARLYGLNYTNFRHNLKKAGIQLNRKVLSQVALRDKQAFEQLILLVKD

SEQ ID NO: 420 - protein, 113 aa, Cyanophora paradoxa
TRVKRGNVARKRRKKILKLASGFRGAHSRLFRVANQQVMKALRYAYNDRNKRKRDFRALWIARINASARLEGMTYSKLMGSLKKLNIILNRKSLSQLAIYDKDAFMEILKTIP

SEQ ID NO: 421 - protein, 127 aa, Epifagus virginiana
TRIKRGYIARRRIKKFRLFASSFLNAHSRLTRTITQQKIRALVSSDRDRNNKKRKFRSLWITRINAVIREEGVSYSYKNFIYAQYKIQLLINRKILAQIAILNRNFFYMIFNEIRKEADLKEYIRIN

SEQ ID NO: 422 - protein, 123 aa, Euglena gracilis
TRIKNNGISKKKRKRKISKMKGWVGGHSKLFRTGNQQLMKARHYAFYDRKKKKNLNKTLWITRINGGLKYYLTINEKYNIFVSFLRKTKTYVNKKLLSEINVRDSKSFSHLSKPIMKSTGINL

SEQ ID NO: 423 - protein, 127 aa, Lathraea clandestina
TRIKRGYIARRRRTKMRLFASSFRGAHSRLTRTITQQKIRALFSAHRDRDKQKINFRRLWIARINAVIRKRGVSYSYSKLIHDLYKRQLLLNRKILAQIAISNRNCLYMISNEIIKETERKEYTGII

SEQ ID NO: 424 - protein, 118 aa, Zea mays
TRVPRGYIARRRRTKMRSFASNFRGAHLRLNRVITQQVRRAFVSSHRDRGRQKRDFRRLWITRINAATRVYNVFNSYSKLIHNLSKKELILNRKMLAQVAVSNPNNLYTISNKIRIIN

SEQ ID NO: 425 - protein, 115 aa, Marchantia polymorpha
TRVKRGYVARKRRKNILTLTSGFQGTHSKLFRTANQQGMRALASSHRDRGKRKRNLRRLWITRVNAAARDNGISYNKLIEYLYKKKILLNRKILAQIAILDKFCFSTIIKNIITE

SEQ ID NO: 426 - protein, 114 aa, Odontella sinensis
MARVKRGNIARKRAKKILQLAKGYRGAHSRLFRIANQQVMKALRYSYVGRKQKKRVFRKLWITRINAASRLNGLSYSRLIHNFKKSNIELNRKMLSQIAVLDIPTFNQLIAISK

SEQ ID NO: 427 - protein, 118 aa, Oryza sativa
TRVPRGYIARRRRAKMRSFASNFRGAHLRLNRMITQQVRRAFVSSHRDRVRQKRDFRRLWISRINAATRIHKVFDNYSKLIHNLYKKELILNRKILAQVAVLNSNNLYTISNKIKIIN

SEQ ID NO: 428 - protein, 118 aa, Pinus thunbergii
TRVKRGYIARKRRKKILAFVSGSRGAHSKLFRTANQRKARALVSAHRDRGKRKRDLRRLWITRINAAARANGVSYNRFIQYLYKRQLLPNRKTLAQIAVLDSNCFSTIFNNLSYDEIG

SEQ ID NO: 429 - protein, 115 aa, Porphyra purpurea
MSRVKRGNVAKKRRAKVFKLAKGFKGAHNSLFRTAKQQVLKALRYSYVGRKRKKRDFRRLWITRINAAAHSQGMNYSTFITALKKDNIALNRKMLAQLASNDIKAFQAILETVKN

SEQ ID NO: 430 - protein, 127 aa, Nicotiana tabacum
TRIKRGYIARRRRTKIRLFASSFRGAHSRLTRTITQQKIRALVSAHRDRDRKKRDFRRLWITRINAVIRERGVSYSYSRLIHDLYKRQLLLNRKILAQIAISNRNCLYMISNEIIKEVDWKESTRII

SEQ ID NO: 431 - protein, 108 aa, Cyanidium caldarium
MTNYAIVKASGRQLWFEPGKYYNINYVHANPGDKIIFYKVLLLKNTNSLLIGKPFVEKVEVHATILQHLKDKKITVFKMQAKKGTKKKKGYKTVLTKIKINCIHNHKK

SEQ ID NO: 432 - protein, 104 aa, Cyanophora paradoxa
MTTYAIIDIAGKQLWVEPKRYYSVNKINVEIGKKIALQRILLLSKIGEKIKIGQPFLNGISINAIILRHFLAPKVIVYKMQPKKKTRRKRGHRQHLTSFLINDF

SEQ ID NO: 433 - protein, 116 aa, Marchantia polymorpha
MSKYAIIETGGQQLRVEPGRFYNIRHFVSLTPNELEQNTKILIYRVLMIRQESTIKMGHPWLKGAIVKGRILHSCLEKKITIYKMISKKKTRRKLGHRQKSTRFIVDSIFLNGKEI

SEQ ID NO: 434 - protein, 105 aa, Odontella sinensis
MKYAIVEISGRQFWIETGKYYDFNRIPTELGKEITLNRVLLLNNEGEILIGKPYLESVTVKGKILEHLRGRKTLVYKMRPKKKTRKKQGHRQELTRVLIEEIKTN

SEQ ID NO: 435 - protein, 104 aa, Porphyra purpurea
MTYAIIEASGKQLWIEEGRYYDLNHIPVEPGQSIILGKVLLLNKDGHVSLGHPCIEGAVIKATVMRHLRGKKITVFKMKPKKKMRLKKGHRQELTRLMIDSIMT

SEQ ID NO: 436 - protein, 115 aa, Astasia longa
MDNKKYKRACVMVRNIKISVVKVRRILDHVRKYSLRNALMLLEFLPYKGSLVIYKAIKSSYFNYKNFWDFNVTLDNLYITKAKADSGPMLKRSCPHSRGKAFPIRKRTCHITSMI

SEQ ID NO: 437 - protein, 114 aa, Cyanophora paradoxa
MATEVKAIAKYVRTSPQKVRRILDQIRGKSYKEAVMLLSVMPYKACSIILKIVDSAAANAQVTKGFNKNKLIISKTFVDKGPTLKRFRPRAQGRGYKILKPTCHITVQVQDQSL

SEQ ID NO: 438 - protein, 116 aa, Euglena gracilis
MEQKKPLESSASIKYVRISPFKVRRILNQIKGRSAKEALMILKFMPYKPSTLIFKLLKSAVSNSIKNYDEDANVLRVLEARADAGPILKRLCPHAQGRGFPIKKRTCHITIKLSIL

SEQ ID NO: 439 - protein, 114 aa, Gracilaria tenuistipitata
MTNKTTKIQATGKYVRLSTAKTRRVLNQIKGKKYQEAILILEFMTYKPCKIIKKILESAGNNALNLKYEKQNLIIKQAFANDGPKLKRFQPRAQGRAFRIQKPTCHITINLSIN

SEQ ID NO: 440 - protein, 148 aa, Zea mays
MTSFKLVKYTPRIKKKKGLRKLARKVPTDRLLKFERVFKAQKRIHMSVFKAQRVLDEIRWRYYEETVMILNLMPYRASYPILKLVYSAAANATHYRDFDKTNLFITKAEVSRSTIMKKFRPRARGRSYSIKKTMCNITIVLNIVKKSK

SEQ ID NO: 441 - protein, 119 aa, Marchantia polymorpha
MQTNTSNKKIRAVAKHIHMSPHKVRRVVSQIRGRSYEQALMILEFMPYRACNPILQLLSSAAANANHNFGLSKTNLFISEIQVNKGTFFKRFQPRAQGRGYPIHKPTCHITIVLNILPK

SEQ ID NO: 442 - protein, 115 aa, Odontella sinensis
MSNTQTVKAVAKYIRMSPHKVRRVLNQIRGRSYQEALMILEFLPYDAGGPVWQVVHSAAANAKNNYGLDKKKLIIEEVFANEGPKLKRIRPRAQGRAYSILKPTCHITVIVKGTS

SEQ ID NO: 443 - protein, 149 aa, Oryza sativa
MTSFKLVKYTPRIKKKKSGLRKLARKVPTDRLLKFERVFKAQKRIHMSVFKVQRVLDEIRWRYYEETVMILNLMPYRASYPILKLVYSAAANATHYRDFDKANLFITKAEVSRSTIMNKFRPRARGRSSPIKKTMCHITIVLNIVKKSK

SEQ ID NO: 444 - protein, 137 aa, Pelargonium hortorum
MIKKNNKKRYTEVCRLGKYIGMSTHKARRVIDQIRGRSYEETLMILELMPYRACYPILKLISSVAANGIHNMNFDETSLIISKAEVNEGPTAKKFKPRAKGQSYPIKRSTCHITIVLRDISLNEKYEEYISENHGPS

SEQ ID NO: 445 - protein, 142 aa, Pinus thunbergii
MESMGNNSPGPEIRALARNIRMSAHKARRVINQIRGRSYGQALMILELMPYGACYPISQLIHSAAANANHNMGLNKANLLVGRVEVNEGAVFKRIQPRAQGRGYPIQKPTCHITIVSEEISRSNDPIMSIESRKKGYVWRRK

SEQ ID NO: 446 - protein, 116 aa, Porphyra purpurea
MNITKNLKETKAVGKYIRLSPHKVRRVLDQIRGRKYQEALIILEFMPYRACYHIKQILESAGANAEHNNGLNKNQLFITKAFADKGPTLKRFQPRAQGRAFPIHKPTCHITLGVSE

SEQ ID NO: 447 - protein, 155 aa, Nicotiana tabacum
MLKKKKTEVYALGEHISMSADKARRVINQIRGRSYEETLMILELMPYRACYPILKLIYSAAANASYNMGSSEANLVISKAEVNGGTTVKKLKPRARGRSFPIKRSTCHITIVMKDISLDDEYVEMYSLKKTRWKKKSTAMPYRDMYNSGGLWDKK

SEQ ID NO: 448 - protein, 93 aa, Arabidopsis thaliana
MDGIKYAVFTDKSIRLLGKNQYTFNVESGSTRTEIKHWVELFFGVMVIAMNSHRLPGKVKRMGPILGHTMHYRRMIITLQPGYSIPPLRKKRT

SEQ ID NO: 449 - protein, 98 aa, Astasia longa
MLNFVRIFLPFLKYQVFTDKTNDLLKYNIYVFDVDKKLNKLQIKNIIEYIFNIKIYSINTYIKNNKYCCFNKIKGLKTNYKRAFIRLKSVNIIPYFSC

SEQ ID NO: 450 - protein, 86 aa, Chlorella vulgaris
MMLDLVKYPVIRTEKTTRLVENNQLSFDVDVRITKPQIRKIIEEFFNVKVLAVNTHRPPRKTNRLGSKPSYKRVIVTVDSDVTLLK

SEQ ID NO: 451 - protein, 100 aa, Euglena gracilis
MFYFISRKFYDQFKYGILTDKTNKLLKNNVYTFDVDIQMSKRQFKDLIETAFSVKITSVNSYVKSSKYYRSNNFEGMKKYYKRMFIKLNDLETIPFFSCL

SEQ ID NO: 452 - protein, 93 aa, Zea mays
MDGIKYAVFTEKSLRLLGKNQYTFNVESGFTKTEIKHWVELFFGVKVVAVNSHRLPGKGRRMGPILGHTMHYRRMIITLQPGYSIPLLDRETN

SEQ ID NO: 453 - protein, 91 aa, Marchantia polymorpha
MNQVKYPVLTEKTIRLLEKNQYSFDVNIDSNKTQIKKWIELFFNVKVISVNSHRLPKKKKKIGTTTGYTVRYKRMIIKLQSGYSIPLFSNK

SEQ ID NO: 454 - protein, 102 aa, Odontella sinensis
MVDSSYFNRSSTNIIKYPIITDKATRLLENNQYSFIVNPYSDKITIKAAIEYLFNVKVIKVNTCHLPKKKKRVGKYLGWKSHYKKAIVTLSQGDRINLFAEN

SEQ ID NO: 455 - protein, 93 aa, Oryza sativa
MDGIKYAVFTEKSLRLLGKNQYTFNVESGFTKTEIKHWVELFFGVKVVAVNSHRLPGKGRRMGPILGHTMHYRRMIITLQPGYSIPLLDREKN

SEQ ID NO: 456 - protein, 91 aa, Pinus thunbergii
MDEVKYPVLTEKSIRLLERNQYTFNVDSQSNKTKIKNWIENFFDVKVIAMNSYRLPEKGGKRVSMIGHPIRCKRVIITLRTGDSIPLFSEQ

SEQ ID NO: 457 - protein, 110 aa, Porphyra purpurea
MRYLKYKRYIMDSIDSRDLLDLVKYPIITDKTTKLLEENQYCFAVDPNATKINIKAAIQYIFNVQVTGVNTCHPPKKKRSIGRFIGKRPHYKKAIITLASKDSINLFPET

SEQ ID NO: 458 - protein, 93 aa, Sinapis alba
MDGIKYAVFTDKSIRLLGKNQYTFNVESGSTRTEIKHWVELFFGVKVIAMNSHRLPGKVKRMGPILGHTMHYRRMIITLQPGYSIPPLRKKRT

SEQ ID NO: 459 - protein, 90 aa, Spinacia oleracea
MDGIKYAVFTDKSIQLLGKKQYTSNVESRSTRTEIKHWVELWNSYEMNSHRLPGKGRRMGPIMGHTMHYRRMIITLQSSYSIPPLRKKRT

SEQ ID NO: 460 - protein, 93 aa, Nicotiana tabacum
MDGIKYAVFTDKSIRLLGKNQYTSNVESGSTRTEIKHWVELFFGVKVIAMNSHRLPGKSRRMGPIMGHTMHYRRMIITLQPGYSIPPLRKKRT

SEQ ID NO: 461 - protein, 93 aa, Triticum aestivum
MDGIKYAVFTEKSLRLLGKNQYTFNVESGFTKTEIKHWVELFFGVKVVAVNSHRLPGKGRRIGPILGHTMHYRRMIITLQPGYSIPLLDREKN

SEQ ID NO: 462 - protein, 77 aa, Odontella sinensis
MRKQQKIHVKIGDNVKIITGFDKNKIGKVSKIDRNTGKIIVKGINFKFKHIKPNAENEVGEIKQFEAPIHHSNVKLN

SEQ ID NO: 463 - protein, 95 aa, Porphyra purpurea
MKSSLIKNTVNKKVKFKKGDLVQILSGSDKKKTGEIIAIIHKTSKVIVKGINLKVEASKDLSKKVETGEITKFEAPIHSSNVMLFSQKNNISSRF

SEQ ID NO: 464 - protein, 104 aa, Pisum sativum
MASVSSIFGCGVSMAPNSSLRNKAIRTERRSACGGLLIECSSRPQKKSTAHHMKTRPRKSRLSDRNRKPTVYAPLPPLPPDFTIVIPADASTVDFTPPPPTPSD

SEQ ID NO: 465 - protein, 83 aa, Odontella sinensis
MAHKKGAGSTKNGRDSNAKRLGVKRFGGQRVKAGNILVRQRGMKFTPGLNVGCGKDFTLYALTDGIVNFDYKNAQQKRINIIG

SEQ ID NO: 466 - protein, 82 aa, Pleurochrysis carterae
MAHKKGAGSTKNGRDSNSKRLGVKVYGDQPVKKGGIIIRQRGLTFKPGINVAVGRDYTLFALQEGDVKFETIADRKFVSVIK

SEQ ID NO: 467 - protein, 86 aa, Porphyra purpurea
MAHKKGSGSTRNGRDSNSKRLGVKKYGGEQVTAGNILIRQRGTKVKPGQNVGKGKDDTLFALIDGFVLFEKSNQKQKTISVYSSKN

SEQ ID NO: 468 - protein, 179 aa, Nicotiana tabacum
MAVSFSLVGAFKGLSLASSSSFLKGDFGAAFPVAPKFSVSFPLKSPLTIESAHKKGAGSTKNGRDSPGQRLGVKIFGDQVAKPGSIIVRQRGTKFHPGKNVGLGKDHTIFSLIDGLVKFEKFGPDRKKISVYPREVQPENPNSYRNRKRESFRLQRERRKARREGVILQSSVDTCFCCC

SEQ ID NO: 469 - protein, 70 aa, Cyanophora paradoxa
MARQCELTGKKANNGYTVSHSHRRTKCLQKANLQTKRIWSPTLKRWLKLQVSTKVIKDLKRKSIDALLKI

SEQ ID NO: 470 - protein, 63 aa, Porphyra purpurea
MSKKCQLTGKVANNGYAVSHSHKRTKKLQNVNLQYKKVWSTEQNKWIKMLISTKAIKTLTKAL

SEQ ID NO: 471 - protein, 151 aa, Nicotiana tabacum
MATMVAGISLRGPVMSSHRTFSVTKRASLPQSKLSSELSFVTSQLSGLKISSTHFISSSAPLSVPFKPSLQPVARRICPFTGKKSNRANKVSHSNHKTKKLQFVNLQYKRIWWEAGKRYVKLRLSTKAIKTIEKNGLDAVAKKAGIDLSKK

SEQ ID NO: 472 - protein, 89 aa, Odontella sinensis
MSTVQFNEMIALPNSEISQAIIQTEKELFQLQFKKATRQPFKPHEIKKAKRRLAQLKTILTSRLDALEKKRGNTVMKLIKKQNYMTGNF

SEQ ID NO: 473 - protein, 67 aa, Porphyra purpurea
MTLPKILDVIQMDDSSLSEEIIAIKRQLFDLRLKRATRQDFKPHLFKHSKHRLAQLLTVEKSRAQSN

SEQ ID NO: 474 - protein, 70 aa, Porphyra purpurea
MAKVDIHPIWYPDAKVYCDGQLIMTIGSTKPELHVDIWSGNHPFFTGSQRIIDTEGRVERFMRKYKMEKD

SEQ ID NO: 475 - protein, 49 aa, Astasia longa
AVPKKKMSHSKSNSRKSNWKRKVIKKINFAVTLGKSLSFGKLSKFYLDD

SEQ ID NO: 476 - protein, 51 aa, Brassica rapa
AVPKKRTSISKKRIRKKIWKRKGYWTSLKAFSLGKSLSTGNSKSFFVQQNK

SEQ ID NO: 477 - protein, 57 aa, Chlorella vulgaris
AVPKKRKSKMKTRLRKAQWKSEASREAAKALSKAKTVIKSLLAANSANLESNSENSN

SEQ ID NO: 478 - protein, 52 aa, Cyanidium caldarium
AVPKKRTSKSKKKSRRSHWINKAKTRIRNFLNLAKSISNKKATSFAYSTIKN

SEQ ID NO: 479 - protein, 53 aa, Euglena gracilis
AVPKKKMSKSRRNSRKSNWKKKVLKKVLFALSLGKSFEANTNVNFSFGDKLPQ

SEQ ID NO: 480 - protein, 58 aa, Zea mays
AVPKKRTSMSKKRIRKNLWKKKTYFSIVQSYSLAKSRSFSRGNEHPKPKGFSGQQANK

SEQ ID NO: 481 - protein, 68 aa, Marchantia polymorpha
AVPKKRTSKSKTRIRKAIWKNKANKSALRAFSLAKSILTNRSKSFYYTINDKLLNSSKSISTSKLDES

SEQ ID NO: 482 - protein, 57 aa, Odontella sinensis
AVPKKRTSKAKKNARKSVWKKKADKAAKKSLSLAKSVLQGKTTSFVYSLYIDELFSI

SEQ ID NO: 483 - protein, 62 aa, Oryza sativa
AVPKKRTSMSKKRIRKNLWKKKTYFSIVQSYSLAKSRSFSGVSEHPKPKGFSRQQTNNRVLG

SEQ ID NO: 484 - protein, 69 aa, Pinus thunbergii
AVPKKRTSRSKKKIRKNVRKGKAYRAAIKAFSLAKSISTGHSKSFYCIVNDDSSGSSESKLTAIDLDDP

SEQ ID NO: 485 - protein, 59 aa, Porphyra purpurea
MAVPKKRTSKAKKNARKANWKNQAKTEAQKALSLAKSVLTGKSNGFVYNTLEVADAIVE

SEQ ID NO: 486 - protein, 54 aa, Nicotiana tabacum
AVPKKRTSTSKKRIRKNIWKRKGYSIALKAFSLAKSLSTGNSKSFFVRQTKINK

SEQ ID NO: 487 - protein, 48 aa, Vicia faba
MPVPKKRTSISKKKIRKNFWKKKGYKAALKAFSLADSILTGTSKVIVL

SEQ ID NO: 488 - protein, 64 aa, Cyanophora paradoxa
MARAKGVRILVTLECTECRSNGERLGGGVSRYATKKNRRNTPNRLELNKFCPYCKKHVLHREIK

SEQ ID NO: 489 - protein, 66 aa, Epifagus virginiana
MAKSKDARVAVILECTSCIRNSVNKVLTGISRYITQKNRRNTPNRLELRKFCPYCYKHMIHGEIKK

SEQ ID NO: 490 - protein, 65 aa, Zea mays
AKGKDVRIRVILECISCVRKGTNKESTGISRYSTQKNRHNTPGQLELRKFCRYCRKHTTHNEIKK

SEQ ID NO: 491 - protein, 64 aa, Marchantia polymorpha
AKSKDIRVTINLECINCAQNDEKRKKGISRYTTQKNRRNTPIRLELKKFCCYCNKHTIHKEIKK

SEQ ID NO: 492 - protein, 64 aa, Odontella sinensis
MGKAKGIRILITLECTECRSNTNKRSNGVSRYTTQKNRRNNPERIELKKYCPHCNKSTIHKEIK

SEQ ID NO: 493 - protein, 65 aa, Oryza sativa
AKGKDVRIRVILQCVSCVRKGANEESAGISRYSTQKNRHNTPGQLELRKFCRYCRKHTIHAEIKK

SEQ ID NO: 494 - protein, 67 aa, Pinus thunbergii
AKSGDIRVTITLECTSCTQDSVYKRFPGISRYTTRKNRRNTPIRLESNKFCPYCYKHTIHGEIKKRD

SEQ ID NO: 495 - protein, 65 aa, Porphyra purpurea
MAKSKGARIVITLECSNKSVDISQKRKAGVFRYTTTKNRRNTPGRIELKKFCPNCNSHCVFKEIK

SEQ ID NO: 496 - protein, 65 aa, Nicotiana tabacum
AKGKDVRVTVILECTSCVRNSVDKVSRGISRYITQKNRHNTPNRLELKKFCPYCYKHTIHGEIKK

SEQ ID NO: 497 - protein, 45 aa, Cyanidium caldarium
MIQRTLTGTNRKKTKRSGFRSRMLQTEEEKLLILDVMKKRYYLVK

SEQ ID NO: 498 - protein, 46 aa, Cyanophora paradoxa
MSKRTLEGSHRKKVRKSGFLSRSQSPTGRRILKARRKKGRKMLVKY

SEQ ID NO: 499 - protein, 48 aa, Odontella sinensis
MTKRTLSNKTRYSILKLSGFRARMSTAQGRKTLKARRKKGRKQLAVRR

SEQ ID NO: 500 - protein, 42 aa, Olisthodiscus luteus
MTKRTLEGTKRKSIRKSGFRARMATKLGRKVLNKRRQKGENS

SEQ ID NO: 501 - protein, 46 aa, Porphyra purpurea
MTKGTLQGSKRKKIRISGFRARMKTPSGRSILNERRRKGRKKIMAS

SEQ ID NO: 502 - protein, 65 aa, Cyanophora paradoxa
MYKLKTRKAAAKRYKAVGNKKISRRKAFRSHLLQKKSTNRKRQLSQVVIASPGDTKKIYLMLPYL

SEQ ID NO: 503 - protein, 64 aa, Odontella sinensis
MPKLKTRKAALKRYKKTATGKFLRRHAYKGHLLMKKSKTQKRKLSQIICVSNNDSKPIKLMLPY

SEQ ID NO: 504 - protein, 65 aa, Porphyra purpurea
MPKLKTSKAIAKRFKVSSSGKILRHKASKSHLLQKKSSKHRRHLSSTCQVDSRDAKNISINLPYL

SEQ ID NO: 505 - protein, 159 aa, Spinacia oleracea
MAMASATATLSFKTPSLSLSPPSTRCSAAQGISLTHFNKQLKSTLNLSSSSSISSSKVQPIVLKNKRISTVDSSVSTSSPSFTVFAAKGYKMKTHKASAKRFRVTGKGKIVRRRAGKQHLLAKKNTKRKNRLSKLIQVDRSDYDNVIGALPYLKVNRKV

SEQ ID NO: 506 - protein, 37 aa, Astasia longa
MKVYSSVRKICKSCGLIRRHGKLFVRCINSKHNQRQN

SEQ ID NO: 507 - protein, 37 aa, Chlorella vulgaris
MKVRPSVKKMCDKCRLIKRKGTLRVICQNPKHKQRQG

SEQ ID NO: 508 - protein, 37 aa, Cyanophora paradoxa
MKVRASVRKMCEKCRTIRRKGRVMVICSNSKHKQRQG

SEQ ID NO: 509 - protein, 37 aa, Epifagus virginiana
MKIRASIRKICEKCRLICRRRRIIVICSNPRHKQRQG

SEQ ID NO: 510 - protein, 37 aa, Euglena gracilis
MKIRSSVKKICNKCYLIRRKNNLLVVCINNKHKQRQG

SEQ ID NO: 511 - protein, 37 aa, Marchantia polymorpha
MKIRASVRKICENCRLIRRRRRIMVVCSNPKHKQRQG

SEQ ID NO: 512 - protein, 37 aa, Odontella sinensis
MKVRPSVKKMCDKCRVIKRKGKIMVICPNAKHKQRQG

SEQ ID NO: 513 - protein, 37 aa, Oryza sativa
MKIRASVRKICTKCRLIRRRGRIRVICSNPKHKQRQG

SEQ ID NO: 514 - protein, 37 aa, Pisum sativum
MKVAASVRKICEKCRLIRRRGRLLVICSNPKHKQRQG

SEQ ID NO: 515 - protein, 37 aa, Pinus thunbergii
MKIRASIRRICGKCRPIRRRKRVMIICSNPRHKQKQG

SEQ ID NO: 516 - protein, 37 aa, Porphyra purpurea
MKVRPSVRKMCEKCRIIRRHRKVMVICNNPKHKQRQG

SEQ ID NO: 517 - protein, 37 aa, Spinacia oleracea
MKIRASVRPICEKCRLIRRRGRIIVICSNPKHKQRQG

SEQ ID NO: 518 - protein, 37 aa, Nicotiana tabacum
MKIRASVRKICEKCRLIRRRGRIIVICSNPRHKQRQG

SEQ ID NO: 519 - protein, 142 aa, Spinacia oleracea
MALLSPLLSLSSVPPITSIAVSSSSFPIKLQNVSVALLPSFGQRLVAHGPVIAQKRGTVVAMVSAAAEETAGEDGDQSKVEEANISVQNLPLESKLQLKLEQKIKMKMAKKIRLRRTGLCAKESLRKRGAWPPSKMKKLKNV

SEQ ID NO: 520 - protein, 179 aa, Cyanophora paradoxa
MSRIGKRLINIPSQVTVSIKDQVFSVKGPKGELSKQIPYGIQVVQQNDHLVVERVAESLLARKLHGLCRTLVSNLVQGVFQGFERRLEIQGVGYRAQMDGKKLVLNIGFSHPVVIEPPTEIQLQVENNTNIIIKGIDKELVGKLAAEIRAVRPPEPYKGKGIRYLGENVKRKVGKAGKK

SEQ ID NO: 521 - protein, 179 aa, Odontella sinensis
MSRIGKLPIKIPANVDITCSGPDLTVKGKFGTLHNTIPDAIGIEEIDGSLIVNVKDNTRSNRALHGLYRTLINNMVTGVSEQFQLTLNLQGVGYRASVQGNSIILNLGYSHPVELVIPEGISVEVVQNTTINLKACDKGNLGLFASNIRSWRPPEPYKGKGILYKGEIVKRKAGKSGKK

SEQ ID NO: 522 - protein, 180 aa, Porphyra purpurea
MSRIGKKIVLLPTNISTQFDGQTITVNGPKGTLLRTLPEGITLEINDGTILVQTSGNSKRANQLHGLSRTLISNMIEGVSTGFSKKLQIQGVGYRSQIDNNNLILSVGYSHVVTIQPPQNIEIKVENNTSITVLGIDKEVVGQVASSIRSIRPPEPYKGKGIRYQGEVVRTKAGKAGKGK

SEQ ID NO: 523 - protein, 155 aa, Porphyra purpurea
MSKKIIQVVLKENIQKLGKSNDVVKVATGYARNFLIPNKMASVATVGMLNQQKLYAAIKEKKIIFAKENARKTQQLLEEIQKFSISKKTGDGETIFGSVTEKEISQIIKNTTNVDIDKQNILIPEIKTIGLYNIEIKLFNQVTANIQLQVLPESN

SEQ ID NO: 524 - protein, 172 aa, Brucella abortus
MKGTGSSNVGLTVKFVRQRQPGRANDGPVNWRETVDRAEKREFVAWLNGAFKESGSVVVAHYTGLTVAQMSDLRSKMRDAGGSVKVAKNRLAKIALQGTESEGIADLFTGQTVVAYANDPITAPKVAVEFAKANDKLVILGGAMGATTLKPMASSRFVRSRRSTNCAQSWLV

SEQ ID NO: 525 - protein, 172 aa, Citrus greening disease-associated bacterium-like organism
MNRQGKSVEISELSKIFSSSGSIVVAHYKGISVAQIKDLRKKMREAGGGVKVAKNRLVKIAIRDTSIRGISDLFVGQSLIVYSDSPVIAPKISVSFSNDNNEFRVLGGVVEKGVLNQDSIKQIASLPDLEGIRAGIISAIQSNATRLVRLLGTPQTQVVRAISAFVDKNQQG

SEQ ID NO: 526 - protein, 164 aa, Escherichia coli
ALNLQDKQAIVAEVSEVAKGALSAVVADSRGVTVDKMTELRKAGREAGVYMRVVRNTLLRRAVEGTPFECLKDAFVGPTLIAYSMEHPGAAARLFKEFAKANAKFEVKAAAFEGELIPASQIDRLATLPTYEEAIARLMATMKEASAGKLVRTLAAVRDAKEAA

SEQ ID NO: 527 - protein, 162 aa, Haemophilus influenzae
ALNLQDKQAIVAEVNEAAKGALSAVIADSRGVTVEKMTELRKSAREAGVTMRVVRNTLLRRAVEGTDYECLKDTFVGPTLIAFSNEHPGARARLFKEFAKANDKFEIKGAAFEGKIQDVEFLATLPTYEEAIARLMGTMKEAAAGKLARTFAALRDKLQEAA

SEQ ID NO: 528 - protein, 164 aa, Helicobacter pylori
MQKQHQRQHKVELVANLKSQFADAKALLICDYKGLSVRKLEALRNKARNQGIKVQVIKNTLAHIAMKETGYSDLDLKETNVFLWGGDQIALSKLVFDFQKEHKDHFVLKAGLFDKESVSVAHVEAVSKLPSKEELMGMLLSVWTAPARYFVTGLDNLRKAKEEN

SEQ ID NO: 529 - protein, 172 aa, Liberobacter africanum
MNRQEKSVEISELSKIFSSSGSVVVAHYKGISVAQIKDLRKKVREAGGGVKVAKNRLVKIAVSDTSLKGVSDLFVGQSLIVYSVDPIVAPKISVSFANDNKQFVVLGGILEKDILDQDSIKRIASLPNIDGIRSMIISAIQFNSTRLVNLLNAPQTKIVRAISAFVDKNQQS

SEQ ID NO: 530 - protein, 174 aa, Methanococcus jannaschii
MASLRPNRCYRDVDKPPYTRKEYVKGVPQPKVVHFIMGNLSAEFPVKVNLVATRPIQIRHNALEAARVAANKYLTKMCGRMGYKFQIRVYPHQILREHKMATGAGADRISDGMRLAFGKPIGTAARVKEGQAILTVWVNPDKFPAAKEALRRAAMKLPVPCRIVIEQGKELLKL

SEQ ID NO: 531 - protein, 162 aa, Mycoplasma genitalium
MVDSKKNKKQQVTDFSNLLSQSKGFVIFDYSGMSAVDATLMRKKLFNKGSKIKIVKNNILRRALKTSNFEGVDESVIKGKIAVAVGINEILETLKVVDSVVKEKELMKFVCGHFDNRIFNSDDLQKIAKLPGRNELYGMFLSVLQAPLRKFLYALQAVRNAK

SEQ ID NO: 532 - protein, 161 aa, Mycoplasma pneumoniae
MEAKKDKAQQVADVSHLLSTSAGFVIFDYTSMSAIEATSIRKKLFKNGSKIKVIKNNILRRALKAGKFEGIDETAIKGKLAVAVGVNEIVETLKAVDGVVKAKEAMNFVCGYFDNRAFNSADLEKIAKLPGRNELYGMFLSVLQAPLRKFLYALEAVKAAK

SEQ ID NO: 533 - protein, 164 aa, Salmonella typhimurium
ALNLQDKQAIVAEVSEVAKGALSAVVADSRGVTVDKMTELRKAGREAGVYMRVVRNTLLRRVVEGTQFECLKDTFVGPTLIAYSMEHPGAAARLFKEFAKANAKFEVKAAAFEGELIPASQIDRLATLPTYEEAIARLMATMKEASAGKLVRTLAAVRDAKEAA

SEQ ID NO: 534 - protein, 176 aa, Streptomyces antibioticus
MARPDKAAAVAELTDKFRSSNAAVLTEYRGLTVAQLKTLRRSLGENAQYAVVKNTLTKIAAKEAGITLEDQLFAGPTAVAFVTGDPVESAKGLRDFAKENPNLVIKGGVLDGKALSADEIKKLADLESREVLLSKLAGAFKAKQSQAASVFQALPSKLVRTVDALRAKQAEQGGAE

SEQ ID NO: 535 - protein, 176 aa, Streptomyces coelicolor
MATPEKAAAVAELTDKFRSSNAAVLTEYRGLTVAQLKTLRRSLGENAQYAVVKNTLTKIAANEAGITLDDQLFAGPTAVAFVTGDPVESAKGLRDFAKDNPNLVIKGGVLDGKAMSADEIKKLADLESREVLLSKLAGAFKGKQSQTAQLFQALPSKLVRTVDALRAKQDEQGGAE

SEQ ID NO: 536 - protein, 185 aa, Streptomyces griseus
MARPDKAAAVAELTDQFRSSNAAVLTEYRGLTVAQLKELRRSLGENAQYAVVKNTLTKIAANEAGIDTLDDLFSGPTAVAFVTGDPVESAKGLRDFAKDNPNLIIKGGVLDGKALSADEIKKLADLESREVLLSKLAGAFKGKQTQAAQVFQALPSKFVRTAEALRAKKEEQGGAGTPAPAEAAE

SEQ ID NO: 537 - protein, 186 aa, Streptomyces virginiae
MPTPNKAASVAELKDAFQSSNAAVLTEYRGLTVAQLKTLRRSLGENAQYAVVKNTLTKIAANQAGITALDEHFAGPTAVAFITGDPVESAKSLRDFAKDNPNLIIKAGVLDGKALTADEIKKLADLESREVLLSKLAGAFKGKQSQAASLFQALPSKFVRTAKRFASSSPSRAVPSNSARALIHAA

SEQ ID NO: 538 - protein, 173 aa, Synechocystis sp. (strain PCC 6803)
MGRTRENKATVISDVQELFQDAQMTVIIDYQGLTVAEITDLRNRLRPLGGTCKIAKNTLVRRALAGQEAWSPMEEFLTGTTAILVLKEDLGGAIKAYKKFQKDTKKTELRGGVLEGKSLTQADVEAIGDLPSKEQLMGQIAGGINALATKIALGIKEVPASVARGLQAHVDKE

SEQ ID NO: 539 - protein, 133 aa, Bacillus stearothermophilus
MKLQIPAGKANPAPPVGPALGQAGVNIMAFCKEFNARTADQAGLIIPVEITVFEDRSFTFITKTPPAAVLLKKAAGIESGSGEPNRNKVATIKRDKVREIAELKMPDLNAASIEAAMRMIEGTARSMGIVVED

SEQ ID NO: 540 - protein, 140 aa, Bacillus subtilis
AKKVVKVVKLQIPAGKANPAPPVGPALGQAGVNVMGFCKEFNARTADQAGLIIPVEISVYEDRSFTFITKTPPAAVLLKKAAGIESGSGEPNRNKVATVKRDKVREIAETKMPDLNAADVEAAMRMVEGTARSMGIVIED

SEQ ID NO: 541 - protein, 141 aa, Citrus greening disease-associated bacterium-like organism
AKVVSRIVKLQIESGSAKPSPPVGPAIGQAGIPIMAFCKAFNAATEGMEKGIPIPTTVTCYKDKSFTFTMSQPPVSFFLKKEVGIKSGSKLPGKESCGSITRENIRKIAQLKMQDMGAIDIEGAMRMVEGSACSMGISVVD

SEQ ID NO: 542 - protein, 170 aa, Chlamydomonas reinhardtii
MREIRISKLVLNIAVAESGDRLQKAAKVLEQLTSQVPVYGRARFTVRSFAIRRNEKISCYVTVRGEKAYDLVKRGLAVKEFELIRKNFSDTGNFGFGIQEHIDLGLKYDPSTGIYGMDFYVCLERRGYRVARRRKQKAHVGVKHKVTKEDAIKWFQQEFDGVVLNKAPAS

SEQ ID NO: 543 - protein, 141 aa, Escherichia coli
AKKVQAYVKLQVAAGMANPSPPVGPALGQQGVNIMEFCKAFNAKTDSIEKGLPIPVVITVYADRSFTFVTKTPPAAVLLKKAAGIKSGSGKPNKDKVGKISRAQLQEIAQTKAADMTGADIEAMTRSIEGTARSMGLVVED

SEQ ID NO: 544 - protein, 141 aa, Haemophilus influenzae
AKKVQAYVKLQVAAGMANPSPPVGPALGQQGVNIMEFCKAFNARTESLEKGLPIPVVITVYADRSFTFVTKTPPAAVLLKKAAGIKSGSGKPNKDKVGKVTLDQVRQIAETKAADMTGATIETKMKSIAGTARSMGLVVEE

SEQ ID NO: 545 - protein, 141 aa, Helicobacter pylori
MAKKVVGEIKLQIPAGKANPSPPVGPALGQRGVNIMEFCKAFNERTKDMGSFNIPVIITVYQDKSFTFITKKPPVTDLIKKASGVEKGSDNPLKNKIAKLTHKQVEEIAQLKMEDLNTSTMEAAKKIVMGSARSMGVEVVD

SEQ ID NO: 546 - protein, 136 aa, Mycoplasma genitalium
AKKTVTRIAKINLIGGQAKPGPALASVGINMGEFTKQFNEKTKDRQGETIPCIITAFNDKSFTFVLKTTPVSNLIKQAAKLEKGAKNAKTIVGKISLQQAKEIAQYKLVDLNANTVEAALKMVLGTAKQMGIEVTD

SEQ ID NO: 547 - protein, 136 aa, Mycoplasma pneumoniae
AKKTITRIAKINLLGGQAKPGPALASVGINMGEFTKQFNEKTKDKQGEMIPCVITAYNDKSFDFILKTTPVSILLKQAAKLEKGAKNAKTIVGKITMAKAKEIAQYKLVDLNANTVEAALKMVLGTAKQMGIEVIE

SEQ ID NO: 548 - protein, 142 aa, Mycobacterium tuberculosis
MAPKKKVAGLIKLQIVAGQANPAPPVGPALGQHGVNIMEFCKAYNAATENQRGNVIPVEITVYEDRSFTFTLKTPPAAKLLLKAAGVAKGSAEPHKTKVAKVTWDQVREIAETKKTDLNANDVDAAAKIIAGTARSMGITVE

SEQ ID NO: 549 - protein, 141 aa, Proteus vulgaris
AKKVQAYIKLQVSAGMANPSPPVGPALGQQGVNIMEFCKAFNAKTESVEKGLPIPVVITVIADRSFTFVTKTPPAAVLLKKAAGVKSGSGKPNKEKVGKITSAQVREIAETKAADLTGADVEAMMRSIAGTARSMGLVVED

SEQ ID NO: 550 - protein, 174 aa, Schizosaccharomyces pombe
MAEKAQNPMKELRISKLVLNISLGESGDRLTRAAKVLEQLSGQTPVFSKARYTIRRFGIRRNEKIACHVTVRGPKAEEILERGLKVKEYELKKRNFSATGNFGFGIQEHIDLGIKYDPSIGIYGMDFYVVMDRPGMRVARRKAQRGRVGYTHKINAEDTINWFKQKYDAVVLGK

SEQ ID NO: 551 - protein, 141 aa, Serratia marcescens
AKKVQAYVKLQVAAGMANPSPPVGPALGQQGVNIMEFCKAFNAKTDSIEKGLPIPVVITVYSDRSFTFVTKTPPAAVLLKKAAGIKSGSGKPNKDKVGKVTRAQVREIAETKAADMTGSDVEAMTRSIEGTARSMGLVVED

SEQ ID NO: 552 - protein, 139 aa, Staphylococcus aureus
AKKVDKVVKLQIPAGKANPAPPVGPALGQAGVNIMGFCKEFNARTQDQAGLIIPVEISVYEDRSFTFITKTPPAPVLLKKAAGIEKGSGEPNKTKVATVTKDQVREIANSKMQDLNAADEEAAMRIIEGTARSMGIVVE

SEQ ID NO: 553 - protein, 139 aa, Staphylococcus carnosus
AKKVEKVVKLQIPAGKANPAPPVGPALGQAGVNIMGFCKEFNARTQEQAGLIIPVEISVYEDRSFTFITKTPPAPVLLKKAAGVEKGSGEPNKNKVATVTKDQVREIAQTKMPDLNAADEEAAMRIIEGTARSMGITVE

SEQ ID NO: 554 - protein, 144 aa, Streptomyces coelicolor
MPPKKKKVTGLIKLQIQAGAANPAPPVGPALGQHGVNIMEFCKAYNAATESQRGWVIPVEITVYEDRSFTFITKTPPAAKMILKAAGVEKGSGEPHKTKVAKITRDQVREIATTKMPDLNANDLDQAEKIIAGTARSMGVTVEG

SEQ ID NO: 555 - protein, 144 aa, Streptomyces griseus
MPPKKKKVTGLIKLQINAGAANPAPPVGPALGQHGVNIMEFCKAYNAATESQRGMVVPVEITVYEDRSFTFVTKTPPAAKLILKAAGVDKGSGEPHKTKVAKLTAAQVREIATTKLPDLNANDLDAASKIIAGTARSMGITVEG

SEQ ID NO: 556 - protein, 144 aa, Streptomyces sp. (strain FRI-5)
MPPKKKKVTGLIKLQIKAGAANPAPPVGPALGQHGVNIMEFCKAYNAATESQRGMVVPVEITVYEDRSFTFVTKTPPAARLILKHAGIEKGSGEPHKTKVANVTRDQVREIATIKMPDLNANDLDAAEKIIAGTARSMGVTVEG

SEQ ID NO: 557 - protein, 144 aa, Streptomyces virginiae
MPPKKKKVTGLIKLQIKAGAANPAPPVGPALGQHGVNIMEFCKAYNAATESQRGMVVPVEITVYDDRSFTFITKTPPAARLILKHAGIEKGSGEPHKTKVAKLTAAQVKEIAELKMPDLNANDIDAAVKIIAGTARSMGVTVEG

SEQ ID NO: 558 - protein, 170 aa, Sulfolobus solfataricus
MPTKTIKIMVEGGSAKPGPPLGPTLSQLGLNVQEVVKKINDVTAQFKGMSVPVTIEIDSSTKKYDIKVGVPTTTSLLLKAINAQEPSGDPAHKKIGNLDLEQIADIAIKKKPQLSAKTLTAAIKSLLGTARSIGITVEGKDPKDVIKEIDQGKYNDLLTNYEQKWNEAEG

SEQ ID NO: 559 - protein, 141 aa, Synechocystis sp. (strain PCC 6803)
MAKKVVALIKLALPAGKANPAPPVGPALGQHGVNIMAFCKEYNAKTADKPGMIIPVEISVFEDRSFTFILKTPPASVLIRKAAGVEKGSSEPNKNKVASITREQLREIAQTKLPDLNANDIDAAMNIIEGTARNMGITVNS

SEQ ID NO: 560 - protein, 172 aa, Tetrahymena thermophila
MTDKKENKMREVKIAKLVINCCVGESGDKLTKAAKVLKDLSGQEPVFSRARYTIRSFGIKRNEKMAVHVTIRGDKARDILTRGLKVKEMELRKKNFSNTGNFGFGIQEHIDLGMKYDPSTGIFGMDFYVVLERPGTRVARRRRATSRVGNNQMISKEECINWFKTEFEGNVY

SEQ ID NO: 561 - protein, 141 aa, Thermotoga maritima
MAKKVAAQIKLQLPAGKATPAPPVGPALGQHGVNIMEFCKRFNAETADKAGMILPVVITVYEDKSFTFIIKTPPASFLLKKAAGIEKGSSEPKRKIVGKVTRKQIEEIAKTKMPDLNANSLEAAMKIIEGTAKSMGIEVVD

SEQ ID NO: 562 - protein, 147 aa, Thermus aquaticus (subsp. thermophilus)
MKKVVAVVKLQLPAGKATPAPPVGPALGQHGANIMEFVKAFNAATANMGDAIVPVEITIYADRSFTFVTKTPPASYLIRKAAGLEKGAHKPGREKVGRITWEQVLEIAKQKMPDLNTTDLEAAARMIAGSARSMGVEVVGAPEVKDA

SEQ ID NO: 563 - protein, 165 aa, Homo sapiens [sequence omitted]

SEQ ID NO: 564 - protein, 165 aa, Mus musculus
MPPKFDPNEVKVVYLRCTGGEVGATSALAPKIGPLGLSPKKVGDDIAKATGDWKGLRITVKLTIQNRQAQIEVVPSASGLIIKALKEPPRDRKKQKNIKHSGNITFDEIVNIARQMRHRSLARELSGTIKEILGTAQSVGCNVDGRHPHDIIDDINSGAVECPAS

SEQ ID NO: 565 - protein, 165 aa, Rattus norvegicus
MPPKFDPNEIKVVYLRCTGGEVGATSALAPKIGPLGLSPKKVGDDIAKATGDWKGLRITVKLTIQNRQAQIEVVPSASALIIKALKEPPRDRKKQKNIKHNGNITFDEIVNIARQMRHRSLARELSGTIKEILGTAQSVGCNVDGRHPHDIIDDINSGAVECPAS

SEQ ID NO: 566 - protein, 165 aa, Saccharomyces cerevisiae
MPPKFDPNEVKYLYLRAVGGEVGASAALAPKIGPLGLSPKKVGEDIAKATKEFKGIKVTVQLKIQNRQAAASVVPSASSLVITALKEPPRDRKKDKNVKHSGNIQLDEIIEIARQMRDKSFGRTLASVTKEILGTAQSVGCRVDFKNPHDIIEGINAGEIEIPEN

SEQ ID NO: 567 - protein, 145 aa, Bacillus subtilis
MRTTPMANASTIERKCLVVDAAGKTLGRLSSEVAAILRGKHKPTYTPHVDTGDHVIIINAEKIELTGKKLTDKIYYRHTQHPGGLKSRTALEMRTNYPEKMLELAIKGMLPKGSLGRQMFKKLNVYRGSEHPHEAQKPEVYELRG

SEQ ID NO: 568 - protein, 142 aa, Escherichia coli [sequence omitted]

SEQ ID NO: 569 - protein, 142 aa, Haemophilus influenzae
MKTFVAKPETVKRDWYVVDATGKTLGRLATELARRLRGKHKAEYTPHVDTGDYIIVINADKVAVTGRKETDKLYYWHTGYVGGIKQATFKEMIARRPEAVIEIAVKGMLPKGPLGRAMFRKLKVYAGGEHQHAAQQPQVLDI

SEQ ID NO: 570 - protein, 142 aa, Haemophilus somnus
MKTFVAKPETVKRDWYVVDATGKTLGRLGHELARRLRGKHKAEYTPHVDTGDYIVVINAEKVAVTGNKETDKLYYWHTGYVGGIKQATFKEMIARRPEAVIEIAVKGMLPKGPLGRAMFRKLKVYAGSEHNHAAQQPQVLDI

SEQ ID NO: 571 - protein, 141 aa, Helicobacter pylori
MTKTAKVNDIVRDWVVLDAKDKVFGRLITEIAVLLRGKHRPFYTPNVDCGDFVVVINANKVKFSGMKLEDKEYFTHSGYFGSTKSKTLQEMLEKAPEKLYHLAVRGMLPKTKLGKAMIKKLKVYRDDKHPHTAQTSKKDAK

SEQ ID NO: 572 - protein, 137 aa, Methanococcus jannaschii
MTVIDAEGAILGRLASEVAKRVLRGEEIVIVNAEMVVITGNKDWIIKTYQEEREKKNVANPRRFGPKFPRRPDDILRRTIRKMLPYKKPKGREAFKRVKVYVGNPKNLTVDEKISHKLNTTKYITLAELSKHLGAKF

SEQ ID NO: 573 - protein, 146 aa, Mycoplasma genitalium
MQKTSMLTKEEAIKNRKWYLVDASGLVLGKLAVKAANLIRGKNKANFTPNQDCGDHLIIINSDQVVLTGNKKDNEFWYHHSQYMGGIKKTSGRDMINKNSDKLVFNAVKGMLPDNRLSRRLITKVHVFKNDKHNMEAQKPTLLNWS

SEQ ID NO: 574 - protein, 147 aa, Mycobacterium leprae
MPTYAPKAGDTTCSWYVIDATDVVLGRLAAVAATLLRGKHKPTFAPNVDGGDFVIVINADKVAISGDKVQHKMVYRHSGYPGGLRKRTIGELMQKHPDRVVEKAIVGMLPKNKLSRQIQRKLRVYAGPDHPHSAQQPVPFEIKQVAQ

SEQ ID NO: 575 - protein, 146 aa, Mycoplasma pneumoniae
MQKTSMLTKEQANKRRQWYIVDAAGLVLGKLAVKAADLIRGKNKVDFTPNQDCGDYLIIINSDQVVLTGNKKENEFWYHHSQYIGGIKKVSGRDMLKKQSDKLVYNAVKGMLPDNRLSRRWITKVHVFKGDKHNMEAQKPTTLNWS

SEQ ID NO: 576 - protein, 147 aa, Mycobacterium tuberculosis
MPTYAPKAGDTTRSWYVIDATDVVLGRLAVAAANLLRGKHKPTFAPNVDGGDFVIVINADKVAISGDKLQHKMVYRHSGYPGGLHKRTIGELMQRHPDRVVEKAILGMLPKNRLSRQIQRKLRVYAGPEHPHSAQQPVPYELKQVAQ

SEQ ID NO: 577 - protein, 145 aa, Staphylococcus carnosus
MRQTFMANESNIERKWYVIDAAGQTLGRLSSEVASILRGKHKATYTPHVDSGDYVIIINAGQIEMTGKKASDKVYYRHSNYPGGIKSITAGELREKNPERLLEISIKGMLPSSRLGEKQGKKLFVYGGAEHPHAAQQPENYELRG

SEQ ID NO: 578 - protein, 147 aa, Streptomyces coelicolor
MRTYSPKPGDVTRQWHVIDAQDVVLGRLATTAASILRGKHKPIYAPHVDTGDFVIIINADKVHLSGNKRTQKMAYRHSGYPGGLRSVRYDELLDKNPEKAVEKAIKGMLPKNSLGRQMLSKLKVYKGDQHPHGAQQPQPFEITQVAQ

SEQ ID NO: 579 - protein, 145 aa, Sulfolobus acidocaldarius
MSSQEEIVIVDATNQILGRMSTHIAKLLKSGKKVYVVNAEKAIISGPRSRVLEGYSLLFTVKTMQNPYRQGIRRPRNPINIVKRTVRGMLPKNKLGKQIYRNLKAYIGILEGKSMIRFDDADVSRLKGKYITVAELSRLLGGLKQ

SEQ ID NO: 580 - protein, 149 aa, Sulfolobus solfataricus
MSTQVQEQVVIINAEGQILGRMASNVVRLLKEGKKVIIVNGEKAVISGEKNRVIESYKLLLTVKTLFNPYRNGIRRPRSPINIVKRTIRGMLPKSSKGRRMLKNVKIYVGVPKEFEGRQFIKFPDSDVSRLKGKYVTVEVVSKELGWSG

SEQ ID NO: 581 - protein, 151 aa, Synechocystis sp. (strain PCC 6803)
MNKTVLPTIDNLDHKWYVIDAEGQRLGRLATEVATILRGKNKPTFTPHMDTGDFVIIINAEKIEVTGRKREQKLYRRHSGRPGGMKEETFEKLQVRLPERIVESAVRGMLPKNSLGRKLFTKLKVYAGPSHPHAAQQPETLVINTIPAGAN

SEQ ID NO: 582 - protein, 123 aa, Acyrthosiphon kondoi symbiotic bacterium
MIQEQTMLNVADNSGARRVMCIKVLGGSHRRYAGVGDIIKITIKEAIPRGKVKKGDVLKAVVVRTKKGVRRPDGSVIRFDGNACVILNNNSEQPVGTRIFGPVTRELRNERFMKIISLAPEVL

SEQ ID NO: 583 - protein, 122 aa, Bacillus stearothermophilus [sequence omitted]

SEQ ID NO: 584 - protein, 122 aa, Bacillus subtilis
MIQQETRLKVADNSGAREVLTIKVLGGSGRKTANIGDVIVCTVKQATPGGVVKKGEVVKAVIVRTKSGARRSDGSYISFDENACVIIRDDKSPRGTRIFGPVARELRENNFMKIVSLAPEVI

SEQ ID NO: 585 - protein, 122 aa, Chlamydia trachomatis
MIQQESQLKVADNTGAKKVKCFKVLGGSRRRYATVGDVIVCSVRDIEPDSSVKKGDVVKAVIVRTRNDIHRKDGSTLRFDTNSCVIIDDKGNPKGTRIFGPVAREIRDRGFVKISSLAPEVI

SEQ ID NO: 586 - protein, 166 aa, Drosophila melanogaster
MPFERFVQTGRIAKASAGPLKGRLVAIVDVIDQNRVLVDGPLTGVPRQEYRLNNLHLTKYRIKFPYTAPTRIVRKAWTESDLKAQWKVSPWSVKAQNICKRSSLNDFDRFKLRYAKRQRNKLLTIAFNTLKKRTKADGTPRVLKKDRRERLRAEKAKGGKKAAAKK

SEQ ID NO: 587 - protein, 123 aa, Escherichia coli [sequence omitted]

SEQ ID NO: 588 - protein, 123 aa, Haemophilus influenzae
MIQEQTMLDVADNSGARSVMCIKVLGGSHRRYAAIGDIIKITVKEAIPRGKVKKGDVLKAVVVRTKKGVRRPDGSVIRFDGNACVILNNNTEQPIGTRIFGPVTRELRSEKFMKIISLAPEVL

SEQ ID NO: 589 - protein, 132 aa, Halobacterium halobium
MEAIKADITQGLEKGSLITCADNTGARELKITSVMGYQGRKNRHPKAGLGDTITVSVTKGTPEMRRQVLEAVVVRQRKPIRRPDGTRVKFEDNAAVIIDDLGEPRGTEIKGPISREVAERYGTIASTATMIV

SEQ ID NO: 590 - protein, 132 aa, Haloarcula marismortui
MEALGADVTQGLEKGSLITCADNTGARELKVISVHGYSGTKNRHPKAGLGDKITVSVTKGTPEMRRQVLEAVVVRQRKPIRRPDGTRVKFEDNAAVIVDENEDPRGTELKGPIAREVAQRFGSVASAATMIV

SEQ ID NO: 591 - protein, 122 aa, Helicobacter pylori
MIQSFTRLNVADNSGAKEIMCIKVLGGSHKRYASVGSVIVASVKKAIPNGKVKRGQVVKAVVVRTKKEIQRKNGSLVRFDDNAAVILDAKKDPVGTRIFGPVSREVRYANFMKIISLAPEVV

SEQ ID NO: 592 - protein, 175 aa, Leishmania donovani
MVKSHYICAGRLVRILRGPRQDRVGVIVDIVDANRVLVENPEDAKMWRHVQNLKNVEPLKYCVSVSRNCSAKALKDALASSKALEKYAKTRTAARVEAKKACAASTDFERYQLRVARRSRAHWARKVFDEKDAKTPVSWHKVALKKMQKKAAKMDSTEGAKRRMQKAIAARKAKK

SEQ ID NO: 593 - protein, 132 aa, Methanococcus jannaschii
MKAIGSKPVRALPVGARCICADNTGAKEVEIIAVRNYKGVARRLPTARVGDMVIVTVKKGTPEMRKQVLPAVVIRQRKEIRRPDGTRVKFADNAVVIVTPDGNPKGSDIKGPVAKEAAERWPGIARIAKIII

SEQ ID NO: 594 - protein, 132 aa, Methanobacterium thermoautotrophicum
MKAIASKVTRALPVGARLQCVDNTGAREVEIISVRGYKGVRRRLAAAGVGDMVVVSVKKGTVDMRREVLNAVIVRQKKEYRRPDGLRVKFEDNAAVIVSPEGVLKGSEIRGPVAKEAADRWPSVGSAASIIV

SEQ ID NO: 595 - protein, 132 aa, Methanococcus vannielii
MKGLGSTIVRSLPNGARLVCADNTGAKELEVIAVKNYSGTVRRLPSAGVGQIVFVSVKKGTPEMRKQVLPAIIIRQKKEYKRADGTRVKFEDNAAVIVTPEGTPKGSDIKGPVSKEAAERWPGVSRLAKIIH

SEQ ID NO: 596 - protein, 122 aa, Micrococcus luteus
MIQQESRLKVADNTGAKEILTIRVLGGSGRRYAGIGDTIVATVKDAIPGGNVKKAHVVKAVVVRTRKQSRRPDGSYIKFDENAAVILKTDGEPRGTRIFGPVGRELRDKKFMKIVSLAPEVI

SEQ ID NO: 597 - protein, 122 aa, Mycoplasma capricolum
MIQTLSKLKVADNSGAKEVRVIRNLGGSVRKFSGIGDIIICSVISATPGAVIKKGQVVKAVIVRTTRELRREDGTYIKFSENAAVLIKEDKTPRGTRIFGPIAREIKEAGFAKIASLAPEVL

SEQ ID NO: 598 - protein, 122 aa, Mycoplasma genitalium
MVSFMTRLNVADNTGAKQVGIIKVLGATYKRYAFLGDVVVVSVKDAIPNGMVKKGQVLRAVIVRTKKGQQRQDGTHLKFHDNACVLIKEDKSPRGTRIFGPVARELREKGYNKILSLAVEVV

SEQ ID NO: 599 - protein, 122 aa, Mycobacterium leprae
MIQQESRLKVADNTGAKEILCIRVLGGSSRRYASIGDVIVGTVKDAIPGGNVKRGDVVKAVVVRTAKECRRPDGSYIKFDENAAVIIKPDNDPRGTRIFGPVGRELREKRFMKIISLAPEVL

SEQ ID NO: 600 - protein, 122 aa, Mycoplasma pneumoniae
MVSFMTRLNVADNTGAKQVGIIKVLGSTRKRYAFLGDVVVVSVKDAIPSGMVKKGQVLRAVIVRTKKGQQRKDGTHLKFDDNACVLIKEDKSPRGTRIFGPVARELRERGYNKILSLAVEVV

SEQ ID NO: 601 - protein, 122 aa, Mycobacterium tuberculosis
MIQQESRLKVADNTGAKEILCIRVLGGSSRRYAGIGDVIVATVKDAIPGGNVKRGDVVKAVVVRTVKERRRPDGSYIKFDENAAVIIKPDNDPRGTRIFGPVGRELREKRFMKIISLAPEVL

SEQ ID NO: 602 - protein, 133 aa, Pisum sativum
MPFKRFVEIGRVALINYGKDYGRLVVIVDVIDQTRALVDAPDMERSPINFKRLSLTDLKIDIKRVPKKKDLIKALEAADVKNKWAKSSWGRKLIVKKTRAALNDFDRFKIMLAKIKRAAGVRQELAKLKKTAA

SEQ ID NO: 603 - protein, 122 aa, Spiroplasma citri
MIQQESRLKVADNSGAKEVLVIKNLGGSWRKFTNIGDIVVCTIKKVTPGGIVKKGQVVKAIIVRTKRGLKRSDGTQIQFSENAVVLIKDDKNPRGTRIFGPIAREVKDAGFVKIASLAPEVL

SEQ ID NO: 604 - protein, 121 aa, Synechococcus sp. (strain PCC 6301)
MIQQETYLNVADNSGARKLMCIRVLGSNRRYAGVGDVIIAVVKDALPNMPVKKSDVVRAVVVRTKKSLRRDSGNVIRFDDNAAVIINADGNPRGTRVFGPVARELRDRNFTKIVSLAPEVI

SEQ ID NO: 605 - protein, 122 aa, Synechocystis sp. (strain PCC 6803)
MIQQQTYLNVADNSGARKLMCLRVLGTGNCTYGGIGDQIIAVVKDALPNMPIKKSDVVRAVIVRTKQPLRRASGMSIRFDDNAAVIINAEGNPRGTRVFGPVARELRDKNFTKIVSLAPEVL

SEQ ID NO: 606 - protein, 122 aa, Thermotoga maritima
MIQQETYLNVADNSGAKKLRIIRVIGGFHKKYGTVGDIVVCSVREAIPNSDVKKGDVVRAVIVRTKKEIRRNDGTYIRFDDNAAVLIDKFNAPRGTRIFGPVARELREKGFMKIVSLAPEVW

SEQ ID NO: 607 - protein, 122 aa, Thermus aquaticus (subsp. thermophilus)
MIQPQTYLEVADNTGARKIMCIRVLKGSNAKYATVGDVIVASVKEAIPRGAVKEGDVVKAVVVRTKKEVKRPDGSAIRFDDNAAVIINNQLEPRGTRVFGPVARELREKGFMKIVSLAPEVL

SEQ ID NO: 608 - protein, 144 aa, Acyrthosiphon kondoi symbiotic bacterium
MRLNTLSPAEGAKHAPKRVGRGIGSGLGKTGGRGHKGQKSRSGGGVRRGFEGGQIPLYRRLPKFGFTSRKAMITAEVRLSELALVEGDVIDLNTLKAANVVGIQIEFVKVILSGEVARPVTLRGLRVTKGARAAIEAAGGKIEE

SEQ ID NO: 609 - protein, 146 aa, Bacillus stearothermophilus
MKLHELQPAPGSRKKAVRVGRGIGSGNGKTSGRGQKGQNARSGGGVRLGFEGGQTPLFRRLPKRGFTNINRKEYAVVNLEKLNRFEDGTEVTPELLLETGVISKLKSGVKILGKGQIEKKLTVKAHKFSASAKEAIEAAGGKTEVI

SEQ ID NO: 610 - protein, 146 aa, Bacillus subtilis
MKLHELKPSEGSRKTRNRVGRGIGSGNGKTAGKGHKGQNARSGGGVRPGFEGGQMPLFQRLPKRGFTNINRKEYAVVNLDKLNGFAEGTEVTPELLLETGVISKLNAGVKILGNGKLEKKLTVKANKFSASAKEAVEAAGGTAEVI

SEQ ID NO: 611 - protein, 144 aa, Chlamydia trachomatis
MIKLECLQDPSPRKRRTKLLGRGPSSGHGKTSGRGHKGDGSRSGYKRRFGYEGGGVPLYRRVPTRGFSHKRFDKCVEEITTQRLNEIFDNGAEVSLEALKERKVIHRETSRVKVILKGALDKKLVWKDAAIVLSEGVKSLIEAV

SEQ ID NO: 612 - protein, 144 aa, Escherichia coli [sequence omitted]

SEQ ID NO: 613 - protein, 144 aa, Haemophilus influenzae
MRLNTLSPAEGAKHSAKRLGRGIGSGLGKTGGRGHKGQKSRTGGGVRRGFEGGQMPLYRRLPKFGFTSMKSAVTAEVRLNELTKVEGNVVTLETLKAANILTKDIQFAKVILAGEVKSAVTVRGLRVTKGAKAAIEAAGGSIEE

SEQ ID NO: 614 - protein, 135 aa, Helicobacter pylori
MIMGLENLKPAKGSVKKIKRVGRGQGSGMGKTATRGGKGQTARTGYKAKRGFEGGQQPLQRRLPKIGFRTKDSHIYSINVEKNEAIKNLEEITFSSLRALHHFPLYIEGVKLIGKDAKNLASKIKDERIKTSGQK

SEQ ID NO: 615 - protein, 143 aa, Methanococcus jannaschii
MIRKKKKVKKIRGSRTCGGGSHKKRRGAGNKGGRGMAGGHKHKWTWIIKYCPDYFGKYGFKRHPSLVKRLETINVGELEEIVLKNPDKFEKEDDKFVVDVIELGYEKVLGKGKVTIPMIVKAVEVSEKAREKIEAVGGEVVEL

SEQ ID NO: 616 - protein, 146 aa, Methanobacterium thermoautotrophicum
MIRKRRKITRMRGSRTVGGGCSKKRRGAGHRGGRGQAGGHKHHWTWIVKYDPKHFGKYGFKRPQKLIKRLETVNLAYLDEMIPELLERGVASEEDGMVVLDVRDLGFEKVLGSGRITRPVHLKAYEFSRSATEKIEEAGGKAEVIE

SEQ ID NO: 617 - protein, 143 aa, Methanococcus vannielii
MIRKSKKITKQRGSRTCGYGEAKKHRGAGHRGGRGNAGHQKHKWLSVCKFNPEYFGKYGFNRNPCLIKKLETINVGELEEYVLKYKDAFKLKDGKVVVNATEIGFEKILGKGRISTAMVVKAVEFSEGAKEKIEAAGGEFVEL

SEQ ID NO: 618 - protein, 150 aa, Micrococcus luteus
MADNDAIKVHDLRPAPGAKTAKTRVGRGEASKGKTAGRGTKGTKARYQVRAGFEGGQLPLQMRLPKLRGFKNPFRTEYQVVNLDKLSAHFPEGGEVTVDALVSKGLVRRGQPVKVLGTGEITAAVQVKANAFSASAVEKIQAAGGSTETL

SEQ ID NO: 619 - protein, 145 aa, Mycoplasma capricolum
MKLNELKYTPGSKKEATRVGRGMASGKGKTATRGHKGQNSRSGGGVRPGFEGGQTPLFRRLPKVGFTSLNQKQYTILNLSDLETLGLEVINHESLIDHKIIKNSSVLVKILANGTLTKKVDVKVNKISKAAKSAIEKLGGKVEVI

SEQ ID NO: 620 - protein, 150 aa, Mycoplasma genitalium
MELHQLKSVSKSRNHKSKVVGRGHGSGLGKTSSRGQKGQKARKSGLTRLGFEGGQTPLYRRLPKYGVANKGILKKRWVVLNLNKVAKLNLKTVTRATLIEKKVISKKNNLPLKLIGNTKLTTPIHFEVQKISKNALNAVQTSKGSVKIIT

SEQ ID NO: 621 - protein, 146 aa, Mycobacterium leprae
MTIKLHDLQPARGSKTTRTRVGRGEASKGKTAGRGTKGTKARKQVPVTFEGGQMPIHMRLPKLKGFRNRLRTEYAVVNVGDISRLFPEGGTISVNDLVAKKAIRKNSLVKILGDGKLTVKVTLSAHKFSGSARHKITVAGGSVTEL

SEQ ID NO: 622 - protein, 151 aa, Mycoplasma pneumoniae
MELNQLKSVPKARNHKTKTLGRGHGSGLGKTSGRGQKGQKARKSGLTRPGFEGGQTPLYRRLPKFGNARKGFLKQEWVVLNLNKIAKLKLDKINRASLIEKQVISAKSQLPIKLIGHTKLEKPLHFEVHKVSKQALKAVENANGSVKLLEK

SEQ ID NO: 623 - protein, 146 aa, Staphylococcus aureus
MKLHELKPAEGSRKERNRVGRGVATGNGKTSGRGHKGQKARSGGGVRPGFEGGQLPLFRRLPKRGFTNINRKEYAIVNLDQLNKFEDGTEVTPALLVESGVVKNEKSGIKILGNGSLDKKLTVKAHKFSASAAEAIDAKGGAHEVI

SEQ ID NO: 624 - protein, 151 aa, Streptomyces coelicolor
MAENNPLKIHNLRPAPGAKTAKTRVGRGEASKGKTAGRGTKGTKARYQVPERFEGGQMPLHMRLPKLKGFKNPFKTEFQVVNLDKLAALYPEGGEVTVEGLVAKGAVRKNSLVKVLGQGEISVALQVTVDAVSGSAKEKITAAGVTVTELV

SEQ ID NO: 625 - protein, 147 aa, Synechocystis sp. (strain PCC 6803)
MNLSELSPKDGAKKRRRRVGRGIAAGQGASCGFGMRGQKSRSGTGTKAGFEGGQMPLYRRLPKLKHFPLYNPKHFTVVNVGKLAGLAPNTVVTLESLMEAGIVTSNDGPLKVLGNGELAVALTVHAPCSKAAQAKIEAAGGSVVAQG

SEQ ID NO: 626 - protein, 150 aa, Thermus aquaticus (subsp. thermophilus)
MKLSDLRPNPGANKRRKRVGRGPGSGHGKTATRGHKGQKSRSGGLKDPRRFEGGRSTTLMRLPKRGMQGQVPGEIKRPRYQGVNLKDLARFEGEVTPELLVRAGLLKKGYRLKILGEGEAKPLKVVAHAFSKSALEKLKAAGGEPVLLEA

SEQ ID NO: 627 - protein, 136 aa, Actinobacillus actinomycetemcomitans
MLQPKRTKFRKVHKGRNRGIAGGTEVSFGTFGLKAVGRGRLTARQIEAARRAMTRAVKRQGKIWIRVFPDKPITEKPLEVRMGKGKGNVEYWVALIQPGKVLYEMDGVSEEIAREAFALAAAKLPVKTTFVTKTVM

SEQ ID NO: 628 - protein, 136 aa, Acyrthosiphon kondoi symbiotic bacterium
MLQPKRTKFRKRHKGRNRGLANGTDVHFGTFGIKAVDRGQMTARQIEAARRTITRAIKRQGQVWIRVYPDTPVTEKPLEVRMGNGKGNVEYWVSKIQPGKVLYEIDGVPEEAAREAFALATSKLPLRTTFVTKTVM

SEQ ID NO: 629 - protein, 144 aa, Bacillus subtilis
MLLPKRVKYRREHRGKMRGRAKGGTEVHFGEFGIQALEASWITNRQIEAARIAMTRYMKRGGKVWIKIFPSKPYTAKPLEVRMGSGKGAPEGWVAVVKPGKVLFEISGVSEEVAREALRLASHKLPIKTKFVKREEIGGESNES

SEQ ID NO: 630 - protein, 136 aa, Escherichia coli [sequence omitted]

SEQ ID NO: 631 - protein, 136 aa, Haemophilus influenzae
MLQPKRTKFRKVHKGRNRGIASGTEVSFGTYGLKAVGRCRLTARQIEAARRAMSRAVKRQGKIWIRVFPDKPITEKPLEVRMGKGKGNVEYWVALIQPGKVLYEMDGVSEEVARNAFALAAAKLPVKTTFVTKTVM

SEQ ID NO: 632 - protein, 141 aa, Helicobacter pylori
MLMPKRTKYRKQMKGRNRGKAHRGNSIAFGDIAIKAIEHGRIDSRQIESARVAMTRHIKRAGKVWIRVFPDKPLTAKPLETRMGKGKGSVEKWVMNIKPGRIVYEMLGIEEGLAREALALAQSKLPFKTKIVTCESENEIY

SEQ ID NO: 633 - protein, 138 aa, Mycobacterium bovis
MLIPRKVKHRKQHHPRQRGIASGGTTVNFGDYGIQALEHAYVTNRQIESARIAINRHIKRGGEVWINIFPGRPLTKKPAETRMGSGKGSPEWWVANVKPGRVLFELSYPNEGVARAALTRAIHKLPIKARIITREEQF

SEQ ID NO: 634 - protein, 137 aa, Mycoplasma capricolum
MLQPKRTKYRKPHRVSYEGKAKGAKEINFGEFGLMALDGAWIDNHQIEAARIAMTRYMKRDGKIWMRIFPHMAMTKKPAEVRMGSGKGNPEKWVAVVKKGTIMFEVAQVNEQVAREALRLAMHKLPIRCKFVKRGEN

SEQ ID NO: 635 - protein, 138 aa, Mycoplasma genitalium
MLQPKRTKYRKPHNVSYEGHTKGNGYVAFGEYGIVATKGNWIDARAIESARVAISKCLGKTGKMWIRIFPHMSKTKKPLEVRMGSGKGNPEFWVAVVKKGTVMFEVANIPEQQMIKALTRAGHKLPVTWKLMKREENS

SEQ ID NO: 636 - protein, 138 aa, Mycobacterium leprae
MLIPRKVKHRKQHHPRQRGIASGGTKVNFGDYGIQALEHAYVTNRQIESARIAINRHIKRGGKVWINIFPDRPLTKKPAETRMGSGKGSPEWWVVNVKPGRVLFELSYPNEQTARAALTRAIHKLPIKARIVTREEQF

SEQ ID NO: 637 - protein, 139 aa, Mycoplasma pneumoniae
MLQPKRTKYRKPHNVSYEGKAKGNSYVAFGEYGLVATKGNWIDARAIESARIAISKCLGKTGKMWIRIFPHMSKTKKPLEVRMGSGKGNPEFWVAVVKQGTVMFEVANIPESQMIKALTRAGHKLPVTWKILKREEVSA

SEQ ID NO: 638 - protein, 137 aa, Spiroplasma citri
MLLPKRTKYRRPHRIKYEGKAKGNTKVDFGEFGLKSLDGAWITNRQIEAARIAMTRYMKRWGKVWIRIFPHMAKTKKPLEVRMGSGKGSPEEWVAVVKTGTVMFEVAGVSEETAREALRLAMHKLPVRCKIVKKGEE

SEQ ID NO: 639 - protein, 142 aa, Synechococcus sp. (strain PCC 6301)
MLSPRRTKFRKQQRGRMTGKATRGNTLAFGNFGLQALECSWITARQIEASRRAMTRYTRRGGKIWIRIFPDKPITMRPAETRMGSGKGNPEFWVAVVKPGRVLFEIGGEVAEETAREAMRLASHKLPIKTKFITRDSEAQEA

SEQ ID NO: 640 - protein, 139 aa, Synechocystis sp. (strain PCC 6803)
MLSPRRTKFRKQQRGRMRGLAERGSTLNFGDYALQATEPCWITSRQIEAARRAMTRYIRRGGKIWIRIFPDKPVTMRPAETRMGSGKGSPEYWVAVVKPGRVMFELAGVSEEVAREAMRLAAQKLPIKTKFISRQEDYI

SEQ ID NO: 641 - protein, 142 aa, Thermotoga maritima
MLMPRRVKYRKQQRGRMKGKAKGGTFVQFGEWGLKALEPAWITAQQIEACRIAMLRVMKRSGKIWIRIFPDKPYTKKPPESRMGKGKGNVEGWVAVVKPGKILFEVAGVDEETAHEALRYAASKLPIATKIVPRHHIGGEAV

SEQ ID NO: 642 - protein, 173 aa, Saccharomyces cerevisiae
SAKAQNPMRDLKIEKLVLNISVGESGDRLTRASKVLEQLSGQTPVQSKARYTVRTFGIRRNEKIAVHVTVRGPKAEEILERGLKVKEYQLRDRNFSATGNFGFGIDEHIDLGIKYDPSIGIFGMDFYVVMNRPGARVTRRKRCKGTVGNSHKTTKEDTVSWFKQKYDADVLDK

SEQ ID NO: 643 - protein, 119 aa, Bacillus stearothermophilus
SYRKLGRTTSQRKALLRDLATDLIINERIETTEARAKELRAVIEKMITLGKRGDLHARRQAAAFIRKEVANSETGQDALQKLFSDIAPRYQDRQGGYTRIMKLGPRRGDGAPMVIIELV

SEQ ID NO: 644 - protein, 119 aa, Bacillus subtilis
SYRKLGRTSAQRKAMLRDLTTDLIINERIETTETRAKELRSVVEKMITLGKRGDLHARRQAAAYIRNEVANEENNQDALQKLFSDIATRYEERQGGYTRIMKLGPRRGDGAPMAIIELV

SEQ ID NO: 645 - protein, 122 aa, Chlamydia trachomatis
MLANMLKSLIHNERIETTLPKAKELRRHADKMITLAKKNTLAARRLAVGRLMVRYNTLTSKEARQVKAGDLSAYNVDRRVIGKLFDVLATRFSSRNRGYTRILKLQNRVGDNAQKCIIEFLA

SEQ ID NO: 646 - protein, 127 aa, Escherichia coli [sequence omitted]

SEQ ID NO: 647 - protein, 128 aa, Haemophilus influenzae
MRHRKSGRQLNRNSSHRQAMFRNLASALVSHEIIKTTLPKAKELRRVVEPLITLAKVDSVANRRLAFARTRNVETVAKLFNELGPRFAQRAGGYTRILKCGFRAGDNAPMAYIELVDRPEVAEATTEE

SEQ ID NO: 648 - protein, 116 aa, Helicobacter pylori
MRHKHGYRKLGRTSSHRKALLKNLAIALIEHNKIETGIYKAKELRSYIEKLTTAARVGDFNAHRHVFAYLQNKEATHKLVTEIAPKYAQRNGGYTRIQRTTFRRGDASTLATIEFV

SEQ ID NO: 649 - protein, 123 aa, Mycoplasma genitalium
MSYINKEGKTTAWRVMTVRQQVSAVLSYGKIQTTLKKAKNTQKRLEKIITIAKVDNFNNRRAVKKWLLNTNSLDVDQLTNHLFKKVAPRFLKRNGGYSRVLKLGVRRGDSTEMAILQLIDATN

SEQ ID NO: 650 - protein, 124 aa, Mycoplasma pneumoniae
MSYINKPGKTSAWRVMTVRQQVSAVLAYGKIETTLKKAKNTQKRLDKLITLAKVDNFNNRRQVKKWLLNTNLFDVDQLMDHLFSKVAPKYEKTPGGYSRVLKLGPRRGDATEMAILQLTDAKYK

SEQ ID NO: 651 - protein, 116 aa, Synechococcus sp. (strain PCC 6301)
MRHRCNVPQLGRPADQRKALLRSLTTEIIRNGTVTTTKARAKAVRSEVERMVTLAKDGSLAARRQALGYIYDKQLVHLLFEQAPERYAKRQGGYTRILRTVRRRGDNAEMAIIELT

SEQ ID NO: 652 - protein, 116 aa, Synechocystis sp. (strain PCC 6803)
MRHRCRVPQLGKPADQRKALLRALTTELIRHGQIKTTKARAKAVRSEVDRMITLAKDGSLAARRRALGYMYDKPTVHALFADAPSRYKDRDGGYTRIIRTLRRRGDNAEMAVIELV

SEQ ID NO: 653 - protein, 117 aa, Acyrthosiphon kondoi symbiotic bacterium
MDKKSARIRRATRARRKLKELGATRLVVHRSPRHMYAQVIAPNGSEVLVAASTLEKAITEQLKYSGNKDAAAAVGKALAERALEKGIAKVSFARSGFQYHGRVQALADAAREAGLQF

SEQ ID NO: 654 - protein, 120 aa, Bacillus stearothermophilus
MITKVDRNAVRKKRHARIRKKIFGTTERPRLSVFRSNKHIYAQIIDDTKSATIVSASTLDKEFGLDSTNNIEAAKKVGELVAKRALEKGIKQVVFDRGGYLYHGRVKALADAAREAGLEF

SEQ ID NO: 655 - protein, 120 aa, Bacillus subtilis
MITKTSKNAARLKRHARVRAKLSGTAERPRLNVFRSNKHIYAQIIDDVNGVTLASASTLDKDLNVESTGDTSAATKVGELVAKRAAEKGISDVVFDRGGYLYHGRVKALADAAREAGLKF

SEQ ID NO: 656 - protein, 123 aa, Chlamydia trachomatis
MESSLYKKTSGKARRALRVRKALKGCSLKPRLSVVKTNKHVYVQLIDDVEGKTLAFISTLAKVAKTSGLTRKNQDNAKALGIKIAELGKGLQVDRVVFDRGAHKYHGVVAMVADGAREGGLQF

SEQ ID NO: 657 - protein, 117 aa, Escherichia coli [sequence omitted]

SEQ ID NO: 658 - protein, 117 aa, Haemophilus influenzae
MDKKSARIRRAARARHMMREQGVTRLVIHRTPRHIYAQVIAPNGSEVLAAASTVEKAIREQVKYTGNKDAAAAVGKAVAERALAKGVQAVAFDRSGFKYHGRVQTLADAAREAGLQF

SEQ ID NO: 659 - protein, 119 aa, Helicobacter pylori
MMNAKALYKKKALRDRRKLRIKSKLLGDALRPRVSVFRSNRYFYAQAIDDVKQSTITHIDGRKMGFKNTQEDAKKLGALFAEELKKAGIERAVYDRNGYLYHGVVAAFAESLRENGIAL

SEQ ID NO: 660 - protein, 119 aa, Micrococcus luteus
MKGKGKFNARTRRHLRVRKRISGTTSVPRLVVNRSARHMFVQVVDDTQSRTIAYASTMEADVRALEGDKTAKAKRVGELVAERAKAAGIEAAVFDRAGNKYHGRVAAVADGAREGGLQL

SEQ ID NO: 661 - protein, 116 aa, Mycoplasma capricolum
MKFTKTEARKRRHFRVRHKVVGTAERPRLNVFKSNTNFYAQIIDDTKGVTLVSASTLKMDLKSKSNIQAAEKVAEELTKKALAANINQVVFDRNGYLYHGKIKAFAQKARENGLKF

SEQ ID NO: 662 - protein, 115 aa, Mycoplasma genitalium
MTRNDKRRIRHKRIVKKIRLTNLNNRVVLIVIKSLKNISVQAWDFSKNVVLTSSSSLQLKLKNGNKENAKLVGMDIATKLIKLNQKDVVFDTGGSKYHGRIAALAEGARAKGLNF

SEQ ID NO: 663 - protein, 122 aa, Mycobacterium leprae
MVQSVSAIRRVSRLRRHARLRKKVSGTSERPRLVVNRSARHIHVQLVNDVTGTTVAAASSIEADVRGLQGDKKVRSVRVGQLIAERAKAAGINTVVFDRGGYTYGGRIAALADSVRENGLNF

SEQ ID NO: 664 - protein, 116 aa, Mycoplasma pneumoniae
MKTRTEQRRLRHKRIVKKIRATNHDNRVVLMVIKSLNHISVQAWDFSQNIVLASSSSLALKLKNGNKDNAKLVGQDIADKLVKLKLTNVVFDTGGSKYHGRIAALAEAARERGLNF

SEQ ID NO: 665 - protein, 127 aa, Streptomyces coelicolor
MAYGQKILKGDAYKRAAIKRRHIRIRKNLSGTAEVPRLVVTRSNRHIVAQVIDDIKGHTLASASTLDTSIRGGEADKSAQAKQVGALVAERAKAAGVEAVVFDRGGNQYAGRIAALADAAREAGLKF

SEQ ID NO: 666 - protein, 120 aa, Synechococcus sp. (strain PCC 6301)
MKVSRRESTRRRHRRVRRTIVGTPARPRLSVFRSNNHIYAQVIDDAAGHTLAAASSLDPDLRQSLTSGGNQQASAAVGKLIAERAQAKGVTTVVFDRGGNLYHGRVKALAEAAREAGLEF

SEQ ID NO: 667 - protein, 120 aa, Synechocystis sp. (strain PCC 6803)
MKSTRKSATQRRHRRLRRHLSGTSERPRLAVFRSNDHIYAQVIDDVAQHTLAAASTLDPDLKKSLSSTATQEASAEVGKLVAQRAIAKGINQVVFDRGGKLYHGRVKALAEAAREAGLNF

SEQ ID NO: 668 - protein, 112 aa, Thermus aquaticus (subsp. thermophilus)
ARLTAYERRKFRVRNRIKRTGRLRLSVFRSLKHIYAQIIDDEKGVTLVSASSLALKAQGATRRGVARQVGRALAEKALALGIKQVAFDRGPYKYHGRVKALAEGAREGGLEF

SEQ ID NO: 669 - protein, 117 aa, Vibrio proteolyticus
MDKKASRIRRATRARRKIAELGATRLVVHRTPRHVYAQVIASNGSEVIAAASTVEKAIREQVKNTGNVDAAKAVGKAIAERALEKGVETVAFDRSGFQYHGRVAALAESAREAGLKF

SEQ ID NO: 670 - protein, 116 aa, Bacillus stearothermophilus
MHHLIQEITKEQLRTDLPDFRPGDTVRVHVKVVEGNRERIQVFEGVVIKRRGAGISETFTVRKVSYGVGVERTFPVHTPKIAKLEVIRRGKVRRAKLYYLRELRGKAARIKEKTAQ

SEQ ID NO: 671 - protein, 118 aa, Bacillus subtilis
MKTMQKLIEDITKEQLRTDLPAFRPGDTLRVHVKVVEGNRERIQIFEGVVIKRRGGGISETFTVRKISYGVGVERTFPVHTPKIAKIEVVRYGKVRRAKLYYLRELRGKAARIKEIRR

SEQ ID NO: 672 - protein, 114 aa, Escherichia coli
SNIIKQLEQEQMKQDVPSFRPGDTVEVKVWVVEGSKKRLQAFEGVVIAIRNRGLHSAFTVRKISNGEGVERVFQTHSPVVDSISVKRRGAVRKAKLYYLRERTGKAARIKERLN

SEQ ID NO: 673 - protein, 115 aa, Haemophilus influenzae
SNIIKQLEQEQLKQNVPSFRPGDTLEVKVWVVEGSKRRLQAFEGVVIAIRNRGLHSAFTLRKVSNGVGVERVFQTHSPAVDSIAVKRKGAVRKAKLYYLRERSGKSARIKERLGA

SEQ ID NO: 674 - protein, 148 aa, Haloarcula marismortui
TDLSAQKRLAADVLDVGKNRVWFNPERQGDIADAITREDVRELVDEGAIQAKDKKGNSRGRARERQKKRAYGHQKGAGSRKGKAGARQNSKEDWESRIRAQRTKLRELRDEGTLSSSQYRDLYDKAGGGEFDSVADLERYIDANHGDA

SEQ ID NO: 675 - protein, 118 aa, Helicobacter pylori
MKNRYIQQFEDAQLKDKTMPAFKAGDTLRLGITIKEGEKTRTQYFEGVCIAIRGNGVDKTFCVRKIGANNIGVEKIFPFYSESLASVEVLRVGRVRRAKLYYLRDRRGKAARIKEVRH

SEQ ID NO: 676 - protein, 151 aa, Methanococcus jannaschii
MIIMDVSVQRRMAAEILKCGIERVWIDPTQLDRVKMAMSKDDIRALIKEGVIKKKQKKGISSARVKKLKEQRKKGRRRGPGSRRGAAGARTPPKERWMATIRALRKTLKQLRDSGKIDRKVYRKLYRMAKGGAFRSRSHLFLYMREHELLK

SEQ ID NO: 677 - protein, 149 aa, Methanococcus vannielii
MDVSTQRRIAAAVLDCGIDRVWVDPENLEKVKMAITKDDIRLLINDGIIVKKQEKGISSARKKEVQEQKRKGKRKGPGSRRGAKGARTPKKEKWMNTIRPLRTLLKELRENEKIERSSYRKLYRMAKGGAFRSRNHMKLYMKEHGILAE

SEQ ID NO: 678 - protein, 119 aa, Mycoplasma genitalium
MKKINKQALIDAVEQKQLKEYVPEFGAGDEVNVAIKLREKEKVRVQNFTGTVLRRRGRGISETFMVRKTTDGIPIEKNFQIHNPNIDIEVKRRGKVRRAYISYMRERSGKSAKIKEKKS

SEQ ID NO: 679 - protein, 113 aa, Mycobacterium leprae
MNRLDFVDQASLRDDIPAFSPGDTINVHVKVIEGVKERIQVFKGVVIRRQGGGIRETFTVRKESYGVGVERTFPVHSPNIDHIEMVIRGDVRRAKLYYLRELRGKKAKIKEKR

SEQ ID NO: 680 - protein, 119 aa, Mycoplasma pneumoniae
MKKINKQALIDLVEQKQLKAYVPEFSAGDEVNVAIKLKEKEKVRIQNFTGTVLRRRGKGISETFIVRKTTDGIPIEKNFQIHNPNISIELKRRGKVRRAYISYMRERSGKAAKIKERKQ

SEQ ID NO: 681 - protein, 113 aa, Mycobacterium tuberculosis
MNRLDFVDKPSLRDDIPAFNPGDTINVHVKVIEGAKERLQVFKGVVIRRQGGGIRETFTVRKESYGVGVERTFPVHSPNIDHIEVVTRGDVRRAKLYYLRELRGKKAKIKEKR

SEQ ID NO: 682 - protein, 114 aa, Salmonella typhimurium
SNIIKQLEQEQMKQNVPSFRPGDTVEVKVWVVEGTKKRLQAFEGVVIAIRNRGLHSAFTVRKISNGEGVERVFQTHSPVVDSIAVKRRGAVRKAKLYYLRERTGKAARIKERLN

SEQ ID NO: 683 - protein, 117 aa, Serratia marcescens
SNIIKQLEQEQMKQDVPAFRPGDSVEVKVWVVEGSKKRLQAFERVVIAIRNRGLHSAFTVRKISNGEGVERVFQTHSPVIDSITVKRRGAVRKAKLYYLRERTGKAARIKERLNRVG

SEQ ID NO: 684 - protein, 115 aa, Streptococcus thermophilus
MNPLIQSLTEGQLRTDIPSFRPGDTVRVHAKVVEGTRERIQIFEGVVISRKGQGISEMYTVRKISSGIGVERTFPIHTPRVDKIEVVRYGKVRRAKLYYLRALQGKAARIKEIRK

SEQ ID NO: 685 - protein, 122 aa, Synechocystis sp. (strain PCC 6803)
MTMNAQAIINSIEAEFLKEDLPTIHVGDTIKVGVKIVEGGKERIQPYEGTVIAKRNGGISETITVRKIFQGVGVERVFLLHSPRVASIKVLRRGKVRRAKLYYLRDRVGKATRIKQRFDRAL

SEQ ID NO: 686 - protein, 137 aa, Saccharomyces cerevisiae
MSGNGAQGTKFRISLGLPVGAIMNCADNSGARNLYIIAVKGSGSRLNRLPAASLGDMVMATVKKGKPELRKKVMPAIVVRQAKSWRRRDGVFLYFEDNAGVIANPKGEMKGSAITGPVGKECADLWPRVASNSGVVV

SEQ ID NO: 687 - protein, 119 aa, Bacillus stearothermophilus
MPRVKGGPVTRRRRKKVLKLAKGYFGAKHALYRVANQQVMKSLMYAYRDRRQRKRDFRKLWIVRINAAARQNGLSYSRLMHGLKLAGVEVNRKIVADLAVNDQAAFAQLADLAKANLNK

SEQ ID NO: 688 - protein, 119 aa, Bacillus subtilis
MPRVKGGTVTRKRRKKVLKLAKGYFGSKHTLYKVANQQVMKSGNYAFRDRRQKKRDFRKLWITRINAAARMNGLSYSRLMHGLKLSGIEVNRKMLADLAVNDLTAFNQLADAAKAQLNK

SEQ ID NO: 689 - protein, 117 aa, Escherichia coli
ARVKRGVIARARHKKILKQAKGYYGARSRVYRVAFQAVIKAGQYAYRDRRQRKRQFRQLWIARINAAARQNGISYSKFINGLKKASVEIDRKILADIAVFDKVAFTALVEKAKAALA

SEQ ID NO: 690 - protein, 116 aa, Haemophilus influenzae
ARVKRGVIARARHKKVLKAAKGYYGARSRVYRVAFQAVIKAGQYAYRDRRQRKRQFRQLWIARINAAARQNGLSYSKFINGLKKASVEIDRKILADIAVFDKVAFAALVEKAKSAL

SEQ ID NO: 691 - protein, 116 aa, Helicobacter pylori
MRVKTGVVRRRRHKKVLKLARGFYSGRRKHFRKAKEQLERSMYYAFRDRKQKKREFRSLWVVRINAACRMHNTSYSRFMHALKVANIELDRKVLADMAMNDMQAFTSVLESVKEHL

SEQ ID NO: 692 - protein, 116 aa, Mycoplasma fermentans
MRVKGGTVTRARRKKWLKLAKGYFGHKSIGYKVAKQAVVKSWTYAFRDRKQIKREFRKLWIARINAATRAEGLSYSKFINGLKRANVTINRKMLSELAISEPKTFAMLIKIARDAK

SEQ ID NO: 693 - protein, 124 aa, Mycoplasma genitalium
MRVKGTNTTRIRRKKWLKQASGSFGTRKASFKAAKQTVIQASKYAYRDRRQKKREFRSLWILRLNAALRAQGMTYSVFINELKKAKIVINRKVLSELAIKEPNKLNLIINTIKKPTNKPTVAKT

SEQ ID NO: 694 - protein, 127 aa, Mycoplasma pneumoniae
MRIKGGKQTRVRRKKWLKQASGSFGTRHASYKVAKQTVIQAAKYAYRDRRNKKRDFRSLWILRLNAALREQGMTYSVFINLLKKHNIEINRKVLSELAIKEPSKFNLIVQKVKSEQPKAAKPAALGN

SEQ ID NO: 695 - protein, 129 aa, Mycobacterium tuberculosis
MARVKRAVNAHKKRRSILKASRGYRGQRSRLYRKAKEQQLHSLNYAYRDRRARKGEFRKLWIARINAAARLNDITYNRLIQGLKAAGVEVDRKNLADIAISDPAAFTALVDVARAALPEDVNAPSGEAA

SEQ ID NO: 696 - protein, 118 aa, Pseudomonas syringae
MARVKRGVIARKRHKKILKLAKGYYGARSRVFRVAKQAVIKAGQYAYRDRRQKKRQFRALWIARINAGARVNGLSYSRFIAGLKKASIEIDRKVLADLAVNEKAAFAAIVEKAKATLA

SEQ ID NO: 697 - protein, 117 aa, Synechocystis sp. (strain PCC 6803)
MTRVKRGNVARKRRKKILKLAKGFRGSHSKLFRTANQQVMKALRNAYRDRRKRKRDFRRLWITRINAAARQEGMSYSKLTGQLKKANIEINRKMLAQLAVLDPAAFSEVVKVAATAK

SEQ ID NO: 698 - protein, 164 aa, Arabidopsis thaliana
MPAGHGVRARTRDLFARPFRKKGYIPLSTYLRTFKVGDYVDVKVNGAIHKGMPHKFYHGRTGRIWNVTKRAVGVEVNKQIGNRIIRKRIHVRVEHVQQSRCAEEFKLRKKKNDELKAAAKANGETISTKRQPKGPKPGFMVEGMTLETVTPIPYDVVNDLKGGY

SEQ ID NO: 699 - protein, 102 aa, Bacillus subtilis
MYAIIKTGGKQIKVEEGQTVYIEKLAAEAGETVTFEDVLFVGGDNVKVGNPTVEGATVTAKVEKQGRAKKITVFRYKPKKNVHKKQGHRQPYTKVTIEKINA

SEQ ID NO: 700 - protein, 160 aa, Caenorhabditis elegans
TNSKGLRRGTRYMFARDFRKHGVEHLSTYYTQYKRGDLVDIKTNGAFQKGMPFKAYHGRTGRIFNVTRGAVGIIVNKRVRGNILPKRINIRIEHIKPSKCRTDFLNRVKSNDEKRKAAKSAGQPVPALKRLPVAPRGAHTVTTQNNEPELLAPLRFEIVA

SEQ ID NO: 701 - protein, 103 aa, Escherichia coli [sequence omitted]

SEQ ID NO: 702 - protein, 166 aa, Entamoeba histolytica
MPLSNGRNRRTRKLFKRPFRGHGLSNTSTILHTYKVGDYVTILCNSSIQHGLPYKAFHGKTGRVWNVNPHAIGVMVNKKVNNRIVVKRLHISPEHIRPSGCQKDFLERKAAVAAIRKQNIQLKKEGKPLLPLPAKRLPKQPRPAELIKGADIKFTTVAPLKFEELY

SEQ ID NO: 703 - protein, 95 aa, Haloarcula marismortui
PSSNGPLEGTRGKLKNKPRDRGTSPPQRAVEEFDDGEKVHLKIDPSVPNGRFHPRFDGQTGTVEGKQGDAYKVDIVDGGKEKTIIVTAAHLRRQE

SEQ ID NO: 704 - protein, 104 aa, Helicobacter pylori
MSYAIFKHGGKQYKVVEGDIVLLDKMDKEPKALVELVEVLAVSKEGKLSCGKPFVNGAKIEAEVINEGRGKKVITFKKRRRKDSKTKRGFRRDFTRVRITKIVA

SEQ ID NO: 705 - protein, 159 aa, Homo sapiens [sequence omitted]

SEQ ID NO: 706 - protein, 98 aa, Methanococcus jannaschii
MVQMSEGFRRKTRKKLSKHPRERGLYPITRALREFKEGEYVHIVIDPSVHKGMPHPRFHGRTGIVVGKQGRAFIVKVRDGGKYKQIIAYPQHLRPATA

SEQ ID NO: 707 - protein, 96 aa, Methanobacterium thermoautotrophicum
MRRSRGFRSKTRHKLQKVKRPGRSNPITRKIQSFNEGDLVHIIIDPSIHRGQPHPRFHGKTGRVVGMMGKSYVVALKDGNKDKQLVVRPEHLQMQE

SEQ ID NO: 708 - protein, 159 aa, Mus musculus
TNTKGKRRGTRYMFSRPFRKHGVVPLATYMRIYKKGDIVDIKGMGTVQKGMPHKCYHGKTGRVYNVTQHAVGIIVNKQVKGKILAKRINVRIEHIKHSKSRDSFLKRVKENDQKKKEAKEKGTWVQLKRHAAPPREAHFVRTNGKEPELLEPIPYEFMA

SEQ ID NO: 709 - protein, 100 aa, Mycoplasma genitalium
MHAIVVCGAKQYLVHENESIFVEKLAGKVGQEIQLDKVLMLDEKIGKPYLEKAKVVCVIEKHGLKSKIKLIKHISQKHHLKRYGHRQPYTKLKVVRFIHD

SEQ ID NO: 710 - protein, 100 aa, Mycoplasma pneumoniae
MHAIVVCGSKQYLVHENDTFFVEKLEAPVGKEIQLDKVLMLDEKIGAPYLEKARVVCVVEKHGLQRKVNVIKHISQKHHLKKYGHRQPYTKLKVVRFVHD

SEQ ID NO: 711 - protein, 159 aa, Rattus norvegicus
TNTKGKRRGTRYMFSRPFRKHGVVPLATYMRIYKKGDIVDIKGMGTVQKGMPHKCYHGKTGRVYNVTQHAVGIIVNKQVKGKILAKRINVRIEHIKHSKSRDSFLKRVKENDQKKKEAKEKGTWVQLNGQPAPPREAHFVRTNGKEPELLEPIPYEFMA

SEQ ID NO: 712 - protein, 124 aa, Synechocystis sp. (strain PCC 6803)
MSYAIIEIGGTQIRVEPGRFYEINHLDAAPEDSYVVDKVLLVKDGDNVTIGQPYVAGATVEGEILSHRRGRKVIVYKMQPKKKTRKKRGHRQELTRLLVKSISVNGTAIAEALEVDAKTPVVAG

SEQ ID NO: 713 - protein, 111 aa, Acholeplasma laidlawii
MEAKAIGKTIRIAPRKVRLVVDLIRGKNVKEAQAILMFTPRGASPVIAKVLDSAIANRTHNLNLNLENLFVKEVWANESITMKRMLPRAKGSGHLIRKRTSHITVVVAERE

SEQ ID NO: 714 - protein, 110 aa, Actinobacillus actinomycetemcomitans
METIAKHRYARTSAQKARLVADLIRGKKVAQALEILTYTNKKASALVKKVLESAIANAEHNDGADIDDLKVAKIFVDEGPSMKRVMPRAKGRADRILKRTSHITVVVSDR

SEQ ID NO: 715 - protein, 113 aa, Bacillus stearothermophilus
MQAKAVARTVRIAPRKARLVIDLIRGKEVGERFAILRHTPKAASPIIEKVLKSAVANAEHNYDMDVNNLVISQAYVDEGPTLKRFRPRAMGRASAINKRTSHITIVVSEKKEG

SEQ ID NO: 716 - protein, 113 aa, Bacillus subtilis
MQAKAVARTVRIAPRKARLVMDLIRGKQVGEAVSILNLTPRAASPIIEKVLKSAIANAEHNYEMDANNLVISQAFVDEGPTLKRFRPRAMGRASQINKRTSHITIVVSEKKEG

SEQ ID NO: 717 - protein, 110 aa, Borrelia burgdorferi
MLVNRRYTAKGKNLPSSPKKVRPIADNIRGESYIKAIAVLCSMPNKGAKLLEKVVKSAASNAMYHNKNLSEDMIFVKTVMVDDGRRRKKIWPRARGRADRLVNRNCHIFR

SEQ ID NO: 718 - protein, 130 aa, Caenorhabditis elegans
MVPKPHAKSAKKALRKKKVHLKFNVECKNPVEDGILRIEDLEAFLNEKIKVNGKTGHLAANNVKVEVAKSKVSVVSEVPFSKRYLKYLTKKYLKRNSLRDWLRVVAVNKNTYEVRYFHINDGEDAGSDHE

SEQ ID NO: 719 - protein, 110 aa, Escherichia coli [sequence omitted]

SEQ ID NO: 720 - protein, 110 aa, Haemophilus influenzae
METIAKHRYARTSAQKARLVADLIRGKKVAQALEILTFTNKKAAALVKKVLESAIANAEHNDGADIDDLKVAKIFVDEGPSMKRVMPRAKGRADRILKRTSHITVVVSDR

SEQ ID NO: 721 - protein, 122 aa, Helicobacter pylori
MSKALLRFVRLSPTKARLIARQIQGMNAELAIASLEFTPNKAARVLSKVVASAVANGSLDAKSALIVSCRVDAGPVLRRSIPRAKGRATAIRKPTSHVFVEVAEGKEMKSSKSHKKNQAEGK

SEQ ID NO: 722 - protein, 156 aa, Methanococcus jannaschii
MIMMGKLKYKIQVNPEKTARAMGRNIPISRKHAREICKSINGMKLDEAIKFLEDVIAMRRPVLFRRHCKKVGHRKGKLGWPAGRYPVKAAKAILKILQHAKANAEYKGLNTEKLRIKHISTNKGITIKRYMPRAFGRATPKFQETVHIQVILEEYH

SEQ ID NO: 723 - protein, 153 aa, Methanobacterium thermoautotrophicum
MAKVKYAYKEEDRSGTARASATHLKISPKHAVEICREIRGMELEKAKKYLEEVIRMERPVAFKRYNRKVGHRRGLNGWASGRYPVKAAGQILKVLENAEANAEYKGLDTEKLRIIHISSHRGPVIRGWIPRAFGRATPFNTPTTHVQIVLGEA

SEQ ID NO: 724 - protein, 111 aa, Mycoplasma capricolum
MEAKAKLSMIRISPRKMRLVADTIRNKAVSVAVATLKNLNKDAAEPILKLLNSAVANAVNNNGMEADKLYVKTIFVNEGPTLKRFRPRAHGRAYEIFKRTSHVVIVVSDEK

SEQ ID NO: 725 - protein, 144 aa, Mycoplasma genitalium
MIAFAKQYRVHISPQKARLVCQLIVGKKINDAQNILLNTPKKAAYFLTKLLNSAISNATNNHGMSGDLLYVFECVANQGPSMKRTIARAKGSGSVLTKRSSNLVIKLSDNPNERKLLLTQQKELVKKRTMGHKKEKAKQKQKQQ

SEQ ID NO: 726 - protein, 175 aa, Mycobacterium leprae
MTTTEFPSAIAKARFVRVSPRKARRVIDLVRGRSVADALDILRWAPQAASEPVARVIASAAANAQNNNGLDPETLVVATVYAGEGPTAKRIRPRAQGRAFRIRRRTSHITVVVESRPVKDQRSAASTKARRAEASKTAGRAPAKKAGASSGATKMPPKKASVKTSEASETKGGSD

SEQ ID NO: 727 - protein, 159 aa, Mycoplasma pneumoniae
MIAFAKQFRVRISPQKARLVCQLIVGKKTADAQNILSNTPKKAATLIAKLLNSAIANATNNHGMNGDALYVFECVANQGPSMKRTIPRAKGSSNMITKRSSNLVVKLSDNPNERQELIKQQKALVKKRVEGQQKAKMARQKAVTSVVKAPSKTQGGVQK

SEQ ID NO: 728 - protein, 153 aa, Mycobacterium smegmatis
MSTVTEFPSATAKARYVRVSATKARRVIDLVRGKSVEEALDILRWAPQAASEPVAKVIASAAANAQNNEGLDPSTLVVATVYADEGPTAKRIRPRAQGRAFRIRKRTSHITVIVESRPPKQKGASAASARSRRAQGSKAAATKKSAETKEGSE

SEQ ID NO: 729 - protein, 127 aa, Rattus norvegicus
APVKKLVAKGGKKKKQVLKFTLDCTHPVEDGIMDAANFEQFLQERIKVNGKAGNLGGGVVTIERSKSKITVTSEEPFSKRYLKYLTKKYLKKNNLRDWLRVVANSKESYELRYFQINQDEEEEEDED

SEQ ID NO: 730 - protein, 115 aa, Schizosaccharomyces pombe
MVNTKVSNKYIIDATAAVNDKIFDVAAFEKYLIDRIKVDGKTGNLGSSVVVSREGSSKIAVIAHIDFSGRYLKYLTKKFLKKHSLRDWLRVVSTKKGVYELRYYNVVVGNDEEEQ

SEQ ID NO: 731 - protein, 112 aa, Spiroplasma citri
MDVRANLRSIRISPRKVRLVTDLIRNKKVGDAIVILNNTNKKSSVPVQKLVKSAESIAVNNNGLDADRLFIKEIFVNERPTLKRFRPRAHGRAYEILKRTSHITVTVSDGQQ

SEQ ID NO: 732 - protein, 117 aa, Synechococcus sp. (strain PCC 6301)
MAVDTANEVKAIARYIRMSPSKVRRVLDQLRGRSYREALILLEFMPYKSCEPILKVLRSAVANAEHNQGLDPTQLVISQAYADMGPSLKRFRPRAQGRAYQIRKQTCHITIAVAPQV

SEQ ID NO: 733 - protein, 121 aa, Synechocystis sp. (strain PCC 6803)
MTKLDTTAEVKAIARYVRMSPLKVRRVLDQIRGRSYREALIILEFMPYKACEPVLKVLRSAVANAEHNEGLEPADLVVSQAFADGGPSLRRFRPRAQGRAYQIRKPTCHITVAVAPALADN

SEQ ID NO: 734 - protein, 159 aa, Thermotoga maritima
MKLQVPRNGLKRSLFHKKRKELLSSLPKIEARAVAKYIRISPRKARAIANTIRGKSVEEAFQILAFSPKKAARIMEKVLKSRVANAENNFGLSVENLYVSECYVNDGPRMKRIWPRGRGRADIIQKRMSHITVVVRDRSREDEYRKALEELQKKISSEE

SEQ ID NO: 735 - protein, 113 aa, Thermus aquaticus (subsp. thermophilus)
MEAKAIARYVRISPRKVRLVVDLIRGKSLEEARNILRYTNKRGAYFVAKVLESAAANAVNNHDMLEDRLYVKAAYVDEGPALKRVLPRARGRADIIKKRTSHITVILGEKHGK

SEQ ID NO: 736 - protein, 130 aa, Tripneustes gratilla
MPGKTAQKGGRPSGKGKKKKQTLKFTIDCTLPVEDGIMDASNFEQFLQERIKVNGKTKNLTTNIVIERKKSKVTVTSEIAFSKRYLKYLTKKYLKKNNLRDWLRVVAANKESYELRYFQINQDDEEEEDD

SEQ ID NO: 737 - protein, 127 aa, Xenopus laevis
APVKKTVTKGSKKKKQLLKFTLDCTHPVEDGIMDAANFEQFLHDRIKVNGKVGNLGGGVVSIERSKSKITVSSEVPFSKRYLKYLTKKYLKKNNLRDWLRVVANSKESYELRYFQINQDEEEEEDED

SEQ ID NO: 738 - protein, 100 aa, Actinobacillus actinomycetemcomitans
MSQERLLKVLKAPHISEKATNNAEKSNTIVFKVALDANKVEITNAVEQLFEVKVDSVRTVVVKGKTKRRGAKIGRRSDWKKAYVTLQEGQSLDFVEGAAE

SEQ ID NO: 739 - protein, 95 aa, Bacillus stearothermophilus
MKDPRDIIKRPIITENTMNLIGQKKYTFEVDVKANKTEVKDAVEKIFGVKVEKVNIMNYKGKFKRVGRYSGYTNRRKKAIVTLTPDSKEIELFEV

SEQ ID NO: 740 - protein, 95 aa, Bacillus subtilis
MKDPRDVLKRPVITERSADLMTEEKYTFEVDVRANKTEAKDAVESIFGVKVDKVNIMNYKGKSKRVGRYTGMTSRRRKAIVKLTADSKEIEIFEA

SEQ ID NO: 741 - protein, 103 aa, Borrelia burgdorferi
MLRISMKAYDIIVSPMLTEKTNTQRESINVYVFKVNKRANKKEVGAAIKELFNVTPVSCNLLNIKSKAKVVVSRKGYPIGKGKTSSWKKAYVYLKKEDKIDIF

SEQ ID NO: 742 - protein, 140 aa, Brugia malayi
MSKRGRGGASGAKFRISLGLPVGAVMNCADNTGAKNLFVIAVSGIKGRLNRLPSAGVGDMFVASVKKGKPELRKKVLQAVVVRQRKQYRRIDGSSIYFEDNAGVIVNNKGEMKGSAITGPVTKECADLWPRIASNAGSIA

SEQ ID NO: 743 - protein, 140 aa, Caenorhabditis elegans
MSKRGRGGASGAKFRISLGLPVGAVMNCADNTGAKNLFVISVYGIRGRLNRLPSAGVGDMFVCSVKKGKPELRKKVLQGVVIRQRKQFRRKDGTFIYFEDNAGVIVNNKGEMKGSAITGPVAKECADLWPRIAANAGSIA

SEQ ID NO: 744 - protein, 140 aa, Drosophila melanogaster
MSKRGRGGTAGGKFRISLGLPVGAVMNCADNTGAKNLYVIAVHGIRGRLNRLPAAGVGDMFVATVKKGKPELRKKVSVVPSARQRKPFRRRDGVFIYFEDNAGVIVNNKGEMKGSAITGPVAKECADLWPRIASNASSIA

SEQ ID NO: 745 - protein, 100 aa, Escherichia coli [sequence omitted]

SEQ ID NO: 746 - protein, 99 aa, Haemophilus influenzae
MSQERLLSVLRAPHISEKATNNAEKSNTVVLKVALDANKAEIAAAVAQLFEVKVDSVRTVVVKGKTKRRGNKMGRRSDWKKAYVTLAEGQNLDFVDSAE

SEQ ID NO: 747 - protein, 93 aa, Helicobacter pylori
MADIMDIKSILYTEKSLGLQEKGVLVVQTAQNVTKNQLKEVFKTYFGFEPLKINSLKQEGKVKRFRGKLGQRKSFKKFYVKVPEGASIAALGA

SEQ ID NO: 748 - protein, 140 aa, Homo sapiens [sequence omitted]

SEQ ID NO: 749 - protein, 86 aa, Methanococcus jannaschii
MDAFDVIKAPVVTEKTVRMIEEENKLVFYVDRRATKQDIKRAMKELFDVEVEKVNTLITPKGEKKAYVKLKEGYDASKIAASLGIY

SEQ ID NO: 750 - protein, 100 aa, Mycobacterium bovis
MATLADPRDIILAPVISEKSYGLLDDNVYTFLVRPDSNKTQIKIAVEKIFGVKVASVNTANRQGKRKRTRTGYGKRKSTKRAIVTLAPGSRPIDLFGAPA

SEQ ID NO: 751 - protein, 94 aa, Mycoplasma capricolum
MHITEVLKKPVLTEKSFAGHKDNVYTFLVDKKANKVQIKKTFEEIFEVKVESVRTINYDAKEKRLGKYVGKKPSYKKAIITLKEGQKLDVLSDL

SEQ ID NO: 752 - protein, 106 aa, Mycoplasma genitalium
MDVTNILLKPVLTEKSYLNQMGELKKYVFAINPKATKTKVKLAFEIIYGVKPLKINTLIRKPVTIRNGTKYPGFSKLAKLAVITLPKGMDIAITGEKTTKKETKDQ

SEQ ID NO: 753 - protein, 100 aa, Mycobacterium leprae
MATIADSRDIILAPVISEKSYGLLDDNVYTFVVHPDSNKTQIKIAIEKIFSVKVASVNTSNRKGKCKRTRTGFGRRKNTKRAIVTLAPGSKSIDLFGTPA

SEQ ID NO: 754 - protein, 100 aa, Synechococcus sp. (strain PCC 6301)
MAEANIRALADIIRRPIITEKATRLLENNQYTFEVDPRASKPEIKAAIEALFQVKVVGLSTQLPPRKARRVGRFAGHRAQVKRAVARLADGDSITLFPEV

SEQ ID NO: 755 - protein, 101 aa, Synechocystis sp. (strain PCC 6803)
MSKVIDQRRLADLIIKPIVTEKATLQLEDNKYVFDVRPEATKPEIKAAIELLFDVKVTGVNTARMPRRKKRVGRFMGFKAQVKRAVVTLKEGDSIQLFPDV

SEQ ID NO: 756 - protein, 100 aa, Thermotoga maritima
MKQEKLSLHDVLIRPIITEKALILREQRKYVFEVNPLANKNLVKEAVEKLFNVKVEKVNILNMKPKPKRRGIFEGKTRSWKKAVVTLKEGYTIKELEGEH

SEQ ID NO: 757 - protein, 140 aa, Nicotiana tabacum
MSKRGRGGSAGNKFRMSLGLPVAATINCADNTGAKNLYIISVKGIKGRLNRLPSACVGDMVMATVKKGKPDLRKKVMPAVVVRQRKPWRRKDGVFMYFEDNAGVIVNAKGEMKGSAITGPIGKECADLWPRIASAANAIV

SEQ ID NO: 758 - protein, 141 aa, Trypanosoma cruzi
MGKEKANVKGCRFRVSLALPVGAVVNCADNTGAKNLYIISVKGYHGRLNRLPAAALGDIVMASVKKGKPELRRKVLNAVIIRQRKSWRRKDGTVIYFEDNAGVIVNSQGRDGRVSGIAGPVAKEAGRPSGPKISSHAPAIV

SEQ ID NO: 759 - protein, 100 aa, Yersinia enterocolitica
MIREERLLKVLRAPHVSEKASAAMEKNNTIVLKVAKDATKAEIKAAVQKLFEVEVEDVNTLLVKGKSKRHGQRVGRRSDWKKAYVTLKEGQNLDFIGGAE

SEQ ID NO: 760 - protein, 100 aa, Yersinia pseudotuberculosis
MIREERLLKVLRSPHVSEKASAAMEKNNTIVLKVAKDATKAEIKAAVQKLFEVEVEDVNTLLVKGKSKRHGQRVGRRSDWKKAYVTLKEGQNLDFIGGAE

SEQ ID NO: 761 - protein, 104 aa, Acyrthosiphon kondoi symbiotic bacterium
MAAKIRREDEVIVITGKDKGKRGKVKNVLSSGKVIVEGINLVKKHQKPVPALNQPGGFVEKEAAIQVSNIALFNAATGKTDRVGFRFEDGKKVRFFKSNSGTIK

SEQ ID NO: 762 - protein, 103 aa, Bacillus stearothermophilus
MHVKKGDKVQVISGKDKGKQGVILAAFPKKNRVIVEGVNIVKKHAKPSQANPQGGIIEKEAPIHVSKVMPLDPKTGEPTRIGYKIVDGKKVRYAKKSGEILDK

SEQ ID NO: 763 - protein, 103 aa, Bacillus subtilis
MHVKKGDKVMVISGKDKGKQGTILAAFPKKDRVLVEGVNMVKKHSKPTQANPQGGISNQEAPIHVSNVMPLDPKTGEVTRVGYKVEDGKKVRVAKKSGQVLDK

SEQ ID NO: 764 - protein, 111 aa, Chlamydia trachomatis
MKRRSVCVGDTVYVLAGNDKGKQGKVLRCLKDKVVVEGINVRVKNIKRSQENPKGKRINIEAPLHISNVRLSIDNQPARLFVKVTEKGRELWNKHSDGSSSLYRLVRERKG

SEQ ID NO: 765 - protein, 103 aa, Escherichia coli
AAKIRRDDEVIVLTGKDKGKRGKVKNVLSSGKVIVEGINLVKKHQKPVPALNQPGGIVEKEAAIQVSNVAIFNAATGKADRVGFRFEDGKKVRFFKSNSETIK

SEQ ID NO: 766 - protein, 103 aa, Haemophilus influenzae
MPAKIRQNDEVIVLTGKDKGKRGKVTKVLPNGKVFVEGINIITKHEKPVPALGKAGGLVKKEAAIDASNVAIFNPKTNKADRVGFRFEDGKKVRFFKSNNEII

SEQ ID NO: 767 - protein, 73 aa, Helicobacter pylori
MKSEIKKNDIVKVIAGDDKGKVAKVLAVLPKTSQVVVEGCKVVKKAIKPTDDNPKGGFIHKEKPMHISNVKKA

SEQ ID NO: 768 - protein, 162 aa, Hordeum vulgare
MVLKTELCRFSGQKIYPGKGIRFIRSDSQVFLFANSKCKRYFHNRLKPAKLCWTAMYRKQHKKDIHAEAAKKRRRTTKKPYSRSIVGATLEVIQKKRAEKPEVRDAAREAALREIKERIKKTKDEKKAKKAEVTKSQKSQGGKGAVQKGSKGPKLGGGGGKR

SEQ ID NO: 769 - protein, 157 aa, Homo sapiens [sequence omitted]

SEQ ID NO: 770 - protein, 155 aa, Kluyveromyces lactis
MKVEIDSFSGAKIYPGRGTLFVRGDSKIFRFQSSKSASLFHQRKNPRRIAWTVLYRRHHKKGITEEVARKRTRKSVKAQRAVVGASLELIKERRSLKPEVRKAQRDEKKKADKEKKKADKAARKSEKAKLAAAQGSKVSKQQAKGAFQKVAATSR

SEQ ID NO: 771 - protein, 120 aa, Methanococcus jannaschii
MAFTKSKQPRKQRKALFNAPLHLRRKVMSAMLSKELKEKLGKNAIPVRKGDVVRIMRGDFKGLEGEVIKVDLKRYRIYVEGANNKRQDGREVPYPIHPSNVMIIKLYDKDEKRFKHIKNE

SEQ ID NO: 772 - protein, 117 aa, Methanobacterium thermoautotrophicum
MSKQPRKQRKYIYEAPLHARRKMMSANLSRELREEYGRRSLPLRKGDKVEILRGDFRGHEGKVEKVDLKRYRVYVEGATIQKVDGTTVYFPLHPSNLRIVDLNLDDEKRIKILERKG

SEQ ID NO: 773 - protein, 119 aa, Methanococcus vannielii
MVLTNSKQPRKQRKALYNAPLHLRNSVMSAMLSKALKEKYGKNALPVKKGDTVKVLRGSFKGIEGEVSKVNYSGYKIIVEGVVNKKQDGKETPYPIHPSNVMITKMEDSDEKRFKTSNK

SEQ ID NO: 774 - protein, 113 aa, Micrococcus luteus
MAKIKKDDLVQVISGKDKGKQGKVLRVFPTDERVLVEGVNRVTKHLRAGQDNNGSTEGGLQVVEAPIHISNVAVVDPETKKPTRVGYRFETVEKDGVTKTVKVRFAKASGKEL

SEQ ID NO: 775 - protein, 108 aa, Mycoplasma capricolum
MAKSRILKGDVVKVIAGSHKGQIGPITSITKDKQWVSVQGITVKKHVKPTNEDSEGGIKDIPAKLHISNVALQDPKNKDQVTKVGFEIIDGKKVRIARKSKTQIKTAK

SEQ ID NO: 776 - protein, 108 aa, Mycoplasma genitalium
MQRIRKGDKVVVITGKNKGGSGIVLKVLTKQNKAIVEGINKVTVHKKEQVNKRSKQTNPTTKEAPLPLNKLALFDQKAKQQTIGKIKYQIDPKTKQKTRVFKKTNNAI

SEQ ID NO: 777 - protein, 105 aa, Mycobacterium leprae
MKVHKGDTVLVIAGKDKGAKGKVLQAYPARNRVLVEGVNRIKKHTAISANQRGAQAGGIVTQEAPIHVSNVMVVDSDGKPTRIGYRVDEETDKRVRISKRNGKDI

SEQ ID NO: 778 - protein, 111 aa, Mycoplasma pneumoniae
MQRIKKGDKVVVITGKNKGGSGIVLKIMPARQQAIVEGLNKVTRHKKKDQTTKRAAKQSTGKVQQEAPIFLSKLALFDQKAKQQTIGKIKYVMDPKTNKKTRVFKKSNNTL

SEQ ID NO: 779 - protein, 113 aa, Synechococcus sp. (strain PCC 6301)
MAAQKPVRHSVHVKKGDTVQVIAGKDKGTVGEVLQVFPKTSRVLVKGVNLRTKHVKPRQEGESGQIVVEEASIHSSNVQLYSTTQKVASRVAYTFTEDGRKVRKLKKTGEIID

SEQ ID NO: 780 - protein, 115 aa, Synechocystis sp. (strain PCC 6803)
MTKTKPAPHRVKMHVKKGDTIQVISGKDKGKVGEVLRTIPSHSQVVVKGVNIRTKHVKPRQEGESGQISSYEAPIHSSKVMLYSTKEKIASRICYTVTDDGRKVRMLKKTGEIID

SEQ ID NO: 781 - protein, 105 aa, Thermotoga maritima
MRIKKGDLVEVISGKDKGKRGKVLRVIPKENKVIVENVNMVKRHQRPVPQLREGGIIEREAPIYASKVMVVCPACDKRTRVGYRFTEDGKKVRYCKKCGEIIDKD

SEQ ID NO: 782 - protein, 110 aa, Thermus aquaticus (subsp. thermophilus)
MQAKVHVKKGDTVLVASGKYKGRVGKVKAVLPRKMAVIVEGVNLVKKAVRPSPKHPQGGFVEQEAPLHASKVRPICPACGKPTRVRKKFLEDGRKIRACAKCGGSLDVEE

SEQ ID NO: 783 - protein, 94 aa, Escherichia coli [sequence omitted]

SEQ ID NO: 784 - protein, 95 aa, Haemophilus influenzae
MAFKFNAEVRTAQGKGASRRLRHNGQIPAIVYGGSEEPVSIILNHDELNNAQAHESFYSEVITLVVEGKEVAVKVQAMQRHPFKPKLVHIDFKRA

SEQ ID NO: 785 - protein, 178 aa, Helicobacter pylori
MLEGVIRESITKANAKALKKDGYLIANVYGKGIENVNGAFKLNPFIKYLKEKKHLIFPVKLGDKTFEVVVQEYQKNPVTNELIHVDLLAVTKGVKSKFKVPIKHQGTPVGLKNKGILMLSKKRISVECAPEHLPDHYLVDVAPLDVNESILVRDLEKHENVKILDHDSIAVIGVIKAK

SEQ ID NO: 786 - protein, 142 aa, Kluyveromyces lactis
MAPSTKATAAKKAVVKGTNGKKALKVRTSASFRLPKTLKLARSPKYATKAVPHYNRLDSYKVIEQPITSETAMKKVEDGNTLVFKVSLKANKYQIKKAVKELYEVDVLSVNTLVRPNGTKKAYVRLTADFDALDIANRIGYI

SEQ ID NO: 787 - protein, 142 aa, Pichia jadinii
MAPSTKAASAKKAVVKGSNGSKALKVRTSTTFRLPKTLKLTRAPKYARKAVPHYQRLDNYKVIVAPIASETAMKKVEDGNTLVFQVDIKANKHQIKQAVKDLYEVDVLAVNTLIRPNGTKKAYVRLTADHDALDIANKIGYI

SEQ ID NO: 788 - protein, 141 aa, Schizosaccharomyces pombe
MSVAKAKGAQKTVQKGIHNKVAKKVRTSTTFRRPKTLQLSRKPKYARKSVAHAPRLDEYKIIVNPINSESAMKKIEDDNTLVFHVHLKANKFTIKEAVRKLYSVEPVKINTLIRPNGTKKAFVKLSADADALDVANRIGFL

SEQ ID NO: 789 - protein, 141 aa, Saccharomyces cerevisiae
APSAKATAAKKAVVKGTNGKKALKVRTSATFRLPKTLKLARAPKYASKAVPHYNRLDSYKVIEQPITSETAMKKVEDGNILVFQVSMKANKYQIKKAVKELYEVDVLKVNTLVRPNGTKKAYVRLTADYDALDIANRIGYI

SEQ ID NO: 790 - protein, 142 aa, Caenorhabditis elegans
MKVNPFVSSDSGKSRKAHFNAPSHERRRIMSAPLTKELRTKHGIRAIPIRTDDEVVVMRGRHKGNTGRVLRCYRKKFVIHIDKITREKANGSTVHIGIHPSKVAITKLKLDKDRRALVERKAAGRSRVTGILKGKHTDETVN

SEQ ID NO: 791 - protein, 145 aa, Homo sapiens [sequence omitted]

SEQ ID NO: 792 - protein, 145 aa, Rattus norvegicus
MKFNPFVTSDRSKNRKRHFNAPSHIRRKIMSSPLSKELRQKYNVRSMPIRKDDEVQVVRGHYKGQQIGKVVQVYRKKYVIYIERVQREKANGTTVHVGIRPSKVVITRLKLDKDRKKILERKAKSRQVGKEKGKYKEETIEKMQE

SEQ ID NO: 793 - protein, 135 aa, Arabidopsis thaliana
MVKFLKQNKAVILLQGRYAGKKAVIIKSFDDGNRDRPYGHCLVAGLKKYPSKVIRKDSAKKTAKKSRVKCFIKLVNYQHLMPTRYTLDVDLKEVATLDALQSKDKKVAALKEAKAKLEERFKTGKNRWFFTKLRF

SEQ ID NO: 794 - protein, 87 aa, Bacillus stearothermophilus
ASKKGVGSTKDGRDSIAKRLGAKRADGQFVTGGSILYRQRGTKVHPGLNVGRGGDDTLYAKIDGIVRFERLGRDRKRVSVYPVSQEA

SEQ ID NO: 795 - protein, 94 aa, Bacillus subtilis
MLRLDLQFFASKKGVGSTKNGRDSEAKRLGAKRADGQFVTGGSILYRQRGTKIYPGENVGRGGDDTLFAKIDGTVKFERFGRDRKKVSVYPVAQ

SEQ ID NO: 796 - protein, 136 aa, Caenorhabditis elegans
MGKIMKPGKVVLVLRGKYAGRKAVVVKQQDEGVSDRTYPHAIIAGIDRYPLKVTKDMGKKKIEKRNKLKPFLKVVSYTHLLPTRYSVDVAFDKTNINKEALKAPSKKRKALVEVKSKFEERYKTGKNKWFFTKLRF

SEQ ID NO: 797 - protein, 84 aa, Escherichia coli
AHKKAGGSTRNGRDSEAKRLGVKRFGGESVLAGSIIVRQRGTKFHAGANVGCGRDHTLFAKADGKVKFEVKGPKNRKFISIEAE

SEQ ID NO: 798 - protein, 84 aa, Haemophilus influenzae
ATKKAGGSTRNGRDSEAKRLGVKRFGGESVLAGSIIVRQRGTKFHAGNNVGMGRDHTLFATADGKVKFEVKGEKSRKYVVIVTE

SEQ ID NO: 799 - protein, 88 aa, Helicobacter pylori
MAHKKGQGSTQNNRDSAGRRLGVKKFGSEFVRAGNIIVRQRGTKMHPGNNVGMGKDHTLYALIDGVVKFEHKDRNRKKVSVVSQNFGE

SEQ ID NO: 800 - protein, 135 aa, Homo sapiens [sequence omitted]

SEQ ID NO: 801 - protein, 104 aa, Mycoplasma genitalium
MSKNSYCYQINLQFFASKKGVGSTKNGRDSHSKRLGAKKADGQMIRVGQIIYRQRGTKIFAGQNVAMGSDNTLFALSDGIVRFQKFGSKQSKTRVNIIKHQLNA

SEQ ID NO: 802 - protein, 104 aa, Mycoplasma pneumoniae
MNNKYFLTKIDLQFFASKKGVGSTKNGRDSHAKRLGAKKADGQMIRTGQIIYRQRGTRVYPGVNVGLGSDDTLFALSDGLVKYQKFGPKQGKTRVSVVKHKLDA

SEQ ID NO: 803 - protein, 135 aa, Pisum sativum
MVKFLKPNKAVILLQGRYAGKKAVIVKTFDDGTREKPYGHCLVAGIKKFPSKVIKKDSAKKTAKKSRVKAFVKLVNYQHLMPTRYTLDVDLKDAVVPDVLQSKDKKVTALKETKKSLEERFKTGKNRWFFTKLRF

SEQ ID NO: 804 - protein, 134 aa, Pyrobotrys stellata
MVKFLKSGKVVVVLSGRFAGKKAVIVRNFDDGTSSRPYGHALVVGLQKEPRKVTKRQSQKKQAKKSTLKTFIKTVNYNHLMPTRYTLDVDFKGVAAEAQENPTKKVEARKECKKLLEEKFKTGKNRWFFTKLRF

SEQ ID NO: 805 - protein, 138 aa, Solanum tuberosum
MEKFLKPNKAVILLQGKYAGRKAVIVRAFDEGTRDRPYGHCLVAGISRYPKKVIRKDSAKKAGKKSRVKAFIKLVNYNHIMPTRYTLDEDLKDVVKDVVNADVLQARDKKVTARRTKARLAERFKTGKNRWFFTKLRF

SEQ ID NO: 806 - protein, 85 aa, Streptomyces griseus
MAHKKGASSTRNGRDSNAQRLGVKRFGGQAVNAGEILVRQRGTHFHPGTGVGRGGDDTLFALAAGAVQFGTHRGRKVVNIVPLAV

SEQ ID NO: 807 - protein, 87 aa, Synechocystis sp. (strain PCC 6803)
MAHKKGTGSTRNGRDSNAQRLGVKRYGGQTVTAGSIIVRQRGTQVHPGNNVGRGKDDTLFALIDGVVKFEHKTRSRRKVSVYPATAE

SEQ ID NO: 808 - protein, 136 aa, Saccharomyces cerevisiae
MAKFLKAGKVAVVVRGRYAGKKVVIVKPHDEGSKSHPFGHALVAGIERYPLKVTKKHGAKKVAKRTKIKPFIKVVNYNHLLPTRYTLDVEAFKSVVSTETFEQPSQREEAKKVVKKAFEERHQAGKNQWFFSKLRF

SEQ ID NO: 809 - protein, 60 aa, Bacillus stearothermophilus
AKCFITGKKKSFGNTRSHAMNASRRDWKANLQKVRILVDGKPKRVWVSARALKSGKVKRV

SEQ ID NO: 810 - protein, 62 aa, Bacillus subtilis
MARKCVITGKKTTAGNNRSHAMNASKRTWGANLQKVRILVNGKPKKVYVSARALKSGKVERV

SEQ ID NO: 811 - protein, 77 aa, Escherichia coli
SRVCQVTGKRPVTGNNRSHALNATKRRFLPNLHSHRFWVESEKRFVTLRVSAKGMRVIDKKGIDTVLAELRARGEKY

SEQ ID NO: 812 - protein, 77 aa, Haemophilus influenzae
SRVCQVTGKRPAVGNNRSHAMNATRRRFLPNLHTHRFWVESENRFVTLRLTAKGMRIIDKKGIDAVLAEIRARGEKI

SEQ ID NO: 813 - protein, 62 aa, Helicobacter pylori
MAKRCALTFKGPMIGNHVSHANNKNKRRLLPNLRSIKIQLDDGTTKRIKVAASTLRTMRKGA

SEQ ID NO: 814 - protein, 136 aa, Homo sapiens
SAHLQWMVVRNCSSFLIKRNKQTYSTEPNNLKARNSFRYNGLIHRKTVGVEPAADGKGVVVVIKRRSGQRKPATSYVRTTINKNARATLSSIRHMIRKNKYRPDLRMAAIRRASAILRTQKPVMVKRKRTRPTKSS

SEQ ID NO: 815 - protein, 136 aa, Mus musculus
SAHLQWMVVRNCSSFLIKRNKQTYSTEPNNLKARNSFRYNGLIHRKTVGVEPAADGKGVVVVMKRRSGQRKPATSYVRTTINKNARATLSSIRHMIRKNKYRPDLRMAAIRRASAILRSQKPVVVKRKRTRPTKSS

SEQ ID NO: 816 - protein, 64 aa, Mycoplasma genitalium
MAKKDQLTLRGPLYGNNRSHSKTITRRKWNVNLQSCKIKDTNGKVTRILVSTKTIRTLKKQNRF

SEQ ID NO: 817 - protein, 65 aa, Mycoplasma pneumoniae
MAKKDQLTLRGPLYGNNRSHSKTITRRKWNVNLQPCKVKTADGKTTRILVSTRTLRTLKKHNRLS

SEQ ID NO: 818 - protein, 94 aa, Mycobacterium tuberculosis
MSARCQITGRTVGFGKAVSHSHRRTRRRWPPNIQLKAYYLPSEDRRIKVRVSAQGIKVIDRDGHRGRRRAARAGSAPAHFARQAGSSLRTAAIL

SEQ ID NO: 819 - protein, 136 aa, Rattus norvegicus
SAHLQWMVVRNCSSFLIKRNKQTYSTEPNNLKARNSFRYNGLIHRKTVGVEAWPDGKGVVVVMKRRSGQRKPATSYVRTTINKNARATLSSIRHMIRKNKYRPDLRMAAIRRASAILRSQKPVVVKRKRTRPTKSS

SEQ ID NO: 820 - protein, 78 aa, Synechocystis sp. (strain PCC 6803)
MARRCQLTGKKANNGFAVSHSHRRTKKLQQANLQWKRVWWPEGNRFVRLRLSTTAIKTLESKGINAMAKEAGINLNKF

SEQ ID NO: 821 - protein, 63 aa, Actinobacillus actinomycetemcomitans
MKAQELRTKSVEELNAELVNLLGEQFKLRMQAATGQLQQTHQLKQVRRSIAQIKTVLTEKAGE

SEQ ID NO: 822 - protein, 63 aa, Acyrthosiphon kondoi symbiotic bacterium
MKAQELREKGVEELNTELLNLLREQFNLRMQGASGQLQQTHLLKQVRRNVARVKTLLTEKAGV

SEQ ID NO: 823 - protein, 66 aa, Bacillus stearothermophilus
MKAKEIRELTTAEIEQKIKALKEELFNLRFQLATGQLENTARIRQVRKDIARMKTIIRERELAANK

SEQ ID NO: 824 - protein, 66 aa, Bacillus subtilis
MKANEIRDLTTAEIEQKVKSLKEELFNLRFQLATGQLENTARIREVRKAIARMKTVIREREIAANK

SEQ ID NO: 825 - protein, 72 aa, Chlamydia trachomatis
MGAKKNLLAELREKSSEELDEFIRDNKKALFALRAEAALQNKVVKTHQFSLYKKSIARALIIKQEKKGRVHG

SEQ ID NO: 826 - protein, 76 aa, Drosophila melanogaster
MAKSKNHTNHNQNKKAHRNGIKRPLRKRHESTLGMDVKFLINQRYARKGNLSREESVKRYNERIASQKGKPKPVTL

SEQ ID NO: 827 - protein, 63 aa, Escherichia coli [sequence omitted]

SEQ ID NO: 828 - protein, 63 aa, Haemophilus influenzae
MKAQDLRTKSVEELNAELVNLLGEQFKLRMQTATGQLQQTHQAKQVRRDIARVKTVLTEKAGE

SEQ ID NO: 829 - protein, 66 aa, Helicobacter pylori
MKYTELKDKSIKELEELLHAKKAELFELRVKLKAMQLSNPNEIKKARRNIARINTAINAHYSSSVE

SEQ ID NO: 830 - protein, 70 aa, Methanococcus jannaschii
MAILRADELRGMSMEELKEKLVELKRELLKERASKAVAGAPSNPGRMREIRRTIARILTIMNEKKRMTSQ

SEQ ID NO: 831 - protein, 64 aa, Methanobacterium thermoautotrophicum
MAILRSEEIREMDGEELQKKLDELKAEYARYISKSAAAGIHENPGKMREIRRTIARVLTIMNEK

SEQ ID NO: 832 - protein, 159 aa, Mus musculus
AKSKNHTTHNQSRKWHRNGIKKPRSQRYESLKGVDPKFLRNMRFAKKHNKKGLKKMQANNAKAVSARAEAIKALVKPQAIKPKMPKGPKLKRLAFIAHPKLGKRIRSYMAKGQRLCQPKPKVQTKAGAKAPAKAQASAPAQAPKGAQAPKGAQAPVKAP

SEQ ID NO: 833 - protein, 75 aa, Mycobacterium bovis
MAVGVSPGELRELTDEELAERLRESKEELFNLRFQMATGQLNNNRRLRTVRQEIARIYTVSARTRTGSGGDWARW

SEQ ID NO: 834 - protein, 138 aa, Mycoplasma capricolum
MAKSKMLDLENLSVDELIKTNESKRAELFALKFQAAVGSLEQTHRIKEIKKEIARIELALSEKRLSGENTNKVIKADYNKAVEEAEKAGKEVRAKQRKFLEEQYGQQSQTKVNEADIQKAMQAAEQETVEPDTKGETK

SEQ ID NO: 835 - protein, 111 aa, Mycoplasma pneumoniae
MTVAKELRQKSSEELVKLVIKLKGELLEYRFKLAHGELDKPHLINQTRRLLATILTILTERKLNWQEEQAKYKLLTKKTNEAAVNAWKQHLEANKAKLLKSRAKREDASKK

SEQ ID NO: 836 - protein, 155 aa, Rattus norvegicus
AKSKNHTTHNQSRKWHRNGIKKPRSQRYESLKGVDPKFLRNMRFAKKHNKKGLKKMQANNAKAVSARAEAIKALVKPQAVKPKMPKGSSRKLSRLAFIAHPKLGKKIRSYMAKGRRLCQPKPKVQTKAEAKAPAKAQAKAPAQAPKGAQAPVKAP

SEQ ID NO: 837 - protein, 64 aa, Synechococcus sp. (strain PCC 6301)
MALPKIEDVRNLSDADLAEKIAEAKRELFDLRFQRATRQLEKPHLFKHTKHRLAQLLTVERERQ

SEQ ID NO: 838 - protein, 73 aa, Synechocystis sp. (strain PCC 6803)
MALPNIADARKLGDEELATEILATKQRLFQLRFQQATRRPENPHEFKHARHRLAQLLTVERERQLENSPSEEA

SEQ ID NO: 839 - protein, 66 aa, Thermotoga maritima
MKASELRNYTDEELKNLLEEKKRQLMELRFQLAMGQLKNTSLIKLTKRDIARIKTILRERELGIRR

SEQ ID NO: 840 - protein, 146 aa, Arabidopsis thaliana [sequence omitted]

SEQ ID NO: 841 - protein, 148 aa, Dictyostelium discoideum
MPTRFSKHRKSRGDVCAGYGRVGKHRKHPGGRGNAGGLTHHRINFDKYHPGYFGKLGMRHFHLLRNQYHCPTVSLEKIWTLVPESVRKSLAAKNDGTAPVVDVTQKGFFKVLGHGILPTQPIIVKARYFSKVAEKKIKAVGGACILVA

SEQ ID NO: 842 - protein, 149 aa, Drosophila melanogaster
MRNIKRKKTRKLRGHVSHGHGRIGKHRKHPGGRGNLGGMHHHRINFDKYHPGYFGKVGMRNFHLRRQHKFRPEINLDKLWSLVGAEKFAELEKEKSTKAPVIDLVKFGYYKLLGRGHLPARPVIVKAKYFSKKAEDKIKEAGGVCLLSA

SEQ ID NO: 843 - protein, 149 aa, Erysiphe graminis (subsp. hordei)
MPTHLSKTRKHRGHVSAGHGRVGKHRKHPGGRGLAGGQHHHRTNMDKYHPGYFGKVGMRYFHKQGNHFWKPVLNLEKLWSLIPAEKREAYLSSTNPDVIPVIDLLPLGYSKVLGKGRIPKVPLVVRARWFSKEAERKITEAGGVVELVA

SEQ ID NO: 844 - protein, 148 aa, Euplotes crassus
MTHSKRNTRKLRGHVSHGHGRVGKHRKHPGGRGMAGPEHHHRINVFKYHPGHIGKHGMRHFHLMRNQYYCPSINLSKLWSLVTEEERQKAQTDKSKVILIDVVKHGYYKVLGKGLLPEVPLVVKAKLFTPTAEKRIKQVGGACVLRAQ

SEQ ID NO: 845 - protein, 147 aa, Homo sapiens [sequence omitted]

SEQ ID NO: 846 - protein, 147 aa, Mus musculus
PSRLRKTRKLRGHVSHGHGRIGKHRKHPSGRGNAGGMHHHRINFDKYHPGYFGKVGMRHYHLKRNQSFCPTVNLDKPWTLVSEQTRVNAAKNKTGVAPIIDVVRSGYYKVLGKGKLPKQPVIVKAKFFSRRAEEKIKGVGGACVLVA

SEQ ID NO: 847 - protein, 149 aa, Neurospora crassa
MPTRFSKTRKHRGHVSAGKGRVGKHRKHPGGRGMAGGQHHHRTNLDKYHPGYFGKVGMRHFHLLRNHQWAPILNIEKLWTLVPAEAREKYVSGAATETAPVIDLLSHGYAKLLGKGRLPQVPIVVRARYVSAEAERKIKEAGGVIELVA

SEQ ID NO: 848 - protein, 145 aa, Oscheius brevesophaga
MAHSLRKTRKLRGHVSHGHGRIGKHRKHPGGRGNAGGQHHHRINRDKYHPGYFGKVGMRVFHLNKNHHYCPTVNVDRLWALVPEEQKTKVSAEKAPVIDCVKAGYFKVLGKGLLPKQPLIVKAKFFSHEAENKIKAAGGACILVA

SEQ ID NO: 849 - protein, 147 aa, Rattus norvegicus
PSRLRKTRKLRGHVSHGHGRIGKHRKHPGGRGNAGGMHHHRINFDKYHPGYFGKVGMRHYHLKRNQSFCPTVNLDKLWTLVSEQTRVNAAKNKNGVAPIIDVVRSGYYKVLGKGKLPKQPVIVKAKFFSRRAEEKIKGVGGACVLVA

SEQ ID NO: 850 - protein, 148 aa, Schizosaccharomyces pombe
MPTHVSKTRKLRGHVSAGHGRIGKHRKHPGGRGKAGGLQHLRSHFDKYHPGYFGKVGMRRFHLMKNPLWRPTVNLDRLWTLLPNEARDKYLGKNTEVAPVINVLQSGYGKVLGKGRLPETPVIVQTRYVSRRAEEKIKQAGGVVELIA

SEQ ID NO: 851 - protein, 148 aa, Tenebrio molitor
MSTHKKKTRKLRGHVSHGHGRIGKHRKHPGGRGNAGGMHHHRINFDKYHPGYFGKLGMRNYHLRRNSKWAPAINLDKLWTLVSEQTRSKYQNHPEGKAPVIDIVKAGYYKLLGKGACLTNLSLLKPSFSLNRLEDKIKAVGGACVLSA

SEQ ID NO: 852 - protein, 149 aa, Tetrahymena thermophila
MVSHLKKTRKLRGHVSHGHGRVGKHRKGGCRGGRGKAGGMHHHRILMEKWHPGYYGKLGMRTFHLKKNPLHCPVVNIDKLWSLVSDATRQKYAEDKKKVPVIDVTKAGFFKVLGKGRLPNQPVVVKAKYFSKTAERRIVAVGGACVLTA

SEQ ID NO: 853 - protein, 147 aa, Xenopus laevis
PSKLRKTRKLRGHVSHGHGRIGKHRKHPGGRGNAGGMHHHRINFDKYHPGYFGKVGMRHYHLKKNQSFCPTINLDKLWTLVSEQTRLNHAKNLEGPAPIIDAVHAGYYKVLGKGKLPKQPVIVKAKFFSRKAEEKIKSVGGACVLGA

SEQ ID NO: 854 - protein, 147 aa, Caenorhabditis elegans
MAPSAPAKTAKALDAKKKVVKGKRTTHRRQVRTSVHFRRPVTLKTARQARFPRKSAPKTSKMDHFRIIQHPLTTESAMKKIEEHNTLVFIVSNDANKYQIKDAVHKLYNVQALKVNTLITPLQQKKAYVRLTADYDALDVANKIGVI

SEQ ID NO: 855 - protein, 149 aa, Drosophila melanogaster
MSNIKRKKTRKLRGHVSHGHGRIGKHRKHPGGRGNAGGMHHHRINFDKYHPGYFGKVGMRNFHLRRQHKFRPEINLDKLWSLVGAEKFAELEKEKSTKAPVIDLVKFGYYKLLGRGHLPARPVIVKAKYFSKKAEDKIKKAGGVCLLSA

SEQ ID NO: 856 - protein, 154 aa, Fritillaria agrestis
MAPPAKVAKKPDGKAQALKVAKAVKSGVSTLQKKAKKIRTSVTFHRPKTLKKDRNPKYPRISAPPRNKLDHYQILKYPLTTESAMKKIEDNNTLVFIVDIRADKKKIKAAVKKMYDIQTKKVNTLIRPDGTKKAYVRLTPDYDALDIANKIGII

SEQ ID NO: 857 - protein, 156 aa, Homo sapiens [sequence omitted]

SEQ ID NO: 858 - protein, 158 aa, Puccinia graminis
MPPKSSTKAEPKASSAKTQVAKAKSAKKAVVKGTSSKTQRRIRTSVTFRRPKTLRLSRKPKYPRTSVPHAPRMDAYRTLVRPLNTESAMKKIEDNNTLLFIVDLKANKRQIADAVKKLYDVTPLRVNTLIRPDGKKKAFVRLTPEVDALDIANKIGFI

SEQ ID NO: 859 - protein, 154 aa, Nicotiana tabacum
MAPAKADPSKKSDPKAQAAKVAKAVKSGSTLKKKSQKIRTKVTFHRPKTLKKDRNPKYPRISAPGRNKLDQYGILKYPLTTESAMKKIEDNNTLVFIVDIKADKKKIKDAVKKMYDIQTKKVNTLIRPDGTKKAYVRLTPDYDALDVANKIGII

SEQ ID NO: 860 - protein, 164 aa, Trypanosoma brucei brucei
MPAKAASAAASKKNSAPKSAVSKKVAKKGAPAAAAKPTKVVKVTKRKAYTRPQFRRPHTYRRPATVKPSSNVSAIKNKWDAFRIIRYPLTTDKAMKKIEENNTLTFIVDSRANKTEIKKAIRKLYQVKTVKVNTLIRPDGLKKAYIRLSASYDALDTANKMGLV

SEQ ID NO: 861 - protein, 146 aa, Caenorhabditis elegans
MAPSSNKVGKAIQAKKAVVKGSKTNVRKNVRTSVHFRRPKTLVTARAPRYARKSAPARDKLDSFAVIKAPHTTESSMKKIEDHNTLVFIVDEKANKHHIKRAVHALYNVKAVKVNTLITPLQQKKAYVRLASDYDALDVANKIGFI

SEQ ID NO: 862 - protein, 59 aa, Acyrthosiphon kondoi symbiotic bacterium
MAKTIKVTQVRSSIGRLPKHKATLLGLGLRRIGHTVEREDTPALRGMINLVSYMVKVEE

SEQ ID NO: 863 - protein, 62 aa, Bacillus stearothermophilus
AKKLAITLTRSVIGRPEDQRITVRTLGLRKMHQTVVHNDNPAIRGMINKVAHLVKVKEIEEE

SEQ ID NO: 864 - protein, 58 aa, Bacillus subtilis
AKLEITLKRSVIGRPEDQRVTVRTLGLKKTNQTVVHEDNAAIRGMINKVSHLVSVKEQ

SEQ ID NO: 865 - protein, 114 aa, Gallus gallus
VAAKKTKKSLESINSRLQLVMKSGKYVLGYKQTLKMIRQGKAKLVILANNCPALRKSEIEYYAMLAKTGVHHYSGNNIELGTACGKYYRVCTLAIIDPGDSDIIRSMPEQTSEK

SEQ ID NO: 866 - protein, 58 aa, Escherichia coli
AKTIKITQTRSAIGRLPKHKATLLGLGLRRIGHTVEREDTPAIRGMINAVSFMVKVEE

SEQ ID NO: 867 - protein, 58 aa, Haemophilus influenzae
AKTIKVTQVRSSIARLPKHKATLRGLGLRHIHHTVELIDTPAVRGMINQVSYMVKVEE

SEQ ID NO: 868 - protein, 114 aa, Homo sapiens
VAAKKTKKSLESINSRLQLVMKSGKYVLGYKQTLKMIRQGKAKLVILANNCPALRKSEIEYYAMLAKTGVHHYSGNNIELGTACGKYYRVCTLAIIDPGDSDIIRSMPEQTGEK

SEQ ID NO: 869 - protein, 104 aa, Kluyveromyces lactis
APAKNQENINQKLALVVKSGKYSLGYKSTVKSLRQGKAKLIIIAANTPVLRKSELEYYAMLSKTKVYYFQGGNNELGTAVGKLFRVGVVTILDAGDSDILTALA

SEQ ID NO: 870 - protein, 104 aa, Leishmania major
MAKKTKSKVNTINAKLQLVMKSGKYVLGTQQALTTLRQGRSKLVVIANNCPPIRRAEVEYYCTLSKTPIHHYSGNNLDLGTACGKPFRTCVLSVTNVGDSDIAT

SEQ ID NO: 871 - protein, 154 aa, Methanococcus jannaschii
MAYAVIRIRGRVGVRRDIADTLKMLRLHKVNHCVIIPETETFKGMLQKVKDYVTWGEIDKDTLVKLILKRGRLPGNKKVNPEIIKELTGMDVEELAEKIINGEIKLKETPLKPVFRLHPPRKGFERGGIKKPFSVGGALGYRGEKINELLEKMM

SEQ ID NO: 872 - protein, 152 aa, Methanobacterium thermoautotrophicum
MFAVVRVRGSAGVRRDIADTMEMLRLNRINHAVLVEDTPSYLGMLQKAKDYITWGEVDQETLTAMIRKRGRLIGGDRITDEYINEKTAYGSVDEFAAAVFSGEVKLEEAGIKPVFRLHPPRKGYEGIKKAFNEGGSLGYRGEKINDLLKRMI

SEQ ID NO: 873 - protein, 154 aa, Methanococcus vannielii
MAYAVVRVRGSVGVRGDIADTMKMLRLHRVNHCVVIPENDHYTGMIKKVKDYVTYGEIDKETLVSLILKRGRLAGNKRLSEELLKELVELPVDALAEKVLAGEIKLKDTPIKPVFRLHPPRRGYDRGGIKKGFSIGGALGYRAGKINDLLNKMM

SEQ ID NO: 874 - protein, 74 aa, Micrococcus luteus
MFESTRKNIQPSDATLVITQTRGVTGSKQNHRDTLRSLGLKRIGHQVTRKADAVTVGMVNTVPHLVSVEEVNNG

SEQ ID NO: 875 - protein, 71 aa, Mycobacterium leprae
MASLKITQVRSTIGVRWKQRESLRTLGLRRIRHSVIREDNLQTRGLIAVVRHLVEVEPATGGSTPVGGGRD

SEQ ID NO: 876 - protein, 109 aa, Schizosaccharomyces pombe
MASVVTKKSKKSGDTINAKLALTMKSGKYVLGYKSTLKTLRSGKAKLILIAGNCPPLRKSELEYYAMLSKANVHHYAGTNIDLGTACGKLFRVGVLAITDAGDSDILDA

SEQ ID NO: 877 - protein, 59 aa, Staphylococcus aureus
MAKLQITLTRSVIGRPETQRKTVEALGLKKTNSSVVVEDNPAIRGQINKVKHLVTVEEK

SEQ ID NO: 878 - protein, 60 aa, Streptomyces coelicolor
MAQLKITQVKSYIGSKQNHRDTLRSLGLKGINTQVVKEDRPEFRGMVHTVRHLVTVEEVD

SEQ ID NO: 879 - protein, 60 aa, Thermus aquaticus (subsp. thermophilus)
MPRLKVKLVKSPIGYPKDQKAALKALGLRRLQQERVLEDTPAIRGNVEKVAHLVRVEVVE

SEQ ID NO: 880 - protein, 105 aa, Trypanosoma brucei brucei
MAKKVKSKVDTINTKIQLVMKSGKYVLGTQQSLKTLRQGRSKLVVISANCPPIRKAEIEYYCTLSKTPIHHYSGNNLDLGTACGRHFRACVLSITDVGDSDITSA

SEQ ID NO: 881 - protein, 66 aa, Bacillus subtilis
MKAGIHPNFKKATVKCACGNEFETGSVKEEVRVEICSECHPFYTGRQKFASADGRVDRFNKKYGLK

SEQ ID NO: 882 - protein, 116 aa, Chlamydomonas reinhardtii
MAKDKSRSKEQVTREYTIHLSKRLHKTSFKKCAPKAVKEIRKFASKVMGTSDVRLDVKLNKAVWSKGIKNVPTRLRIVISRRRNDDEDAKEEMYSFVTVAEDQSTKGKGTVVVQDA

SEQ ID NO: 883 - protein, 70 aa, Escherichia coli
MKKDIHPKYEEITASCSCGNVMKIRSTVGHDLNLDVCSKCHPFFTGKQRDVATGGRVDRFNKRFNIPGSK

SEQ ID NO: 884 - protein, 70 aa, Haemophilus ducreyi
MKQGIHPEYKEITATCSCGNVIKTRSTVEKNLNLDVCGNCHPFYTGKQRVVDTGGRVERFNKRFNIPSTK

SEQ ID NO: 885 - protein, 70 aa, Haemophilus influenzae
MKQGIHPEYKEITATCSCGNVIKTRSTLGKDINLDVCGNCHPFYTGKQRVVDTGGRVERFNSRFKIPSTK

SEQ ID NO: 886 - protein, 67 aa, Helicobacter pylori
MKKGIHPEYIPCKVTCVTSGKEIEVLSTKPEMRIDISSFCHPFYTGSDKIADTAGRVEKFKQRYNLK

SEQ ID NO: 887 - protein, 125 aa, Homo sapiens [sequence omitted]

SEQ ID NO: 888 - protein, 87 aa, Methanococcus jannaschii
MEVLMMEERIYTIPLRDVINKSVRTKRAPRAIKKIKQFLKRHMKAEIVKIDNELNEKIWERGIQKPPARVRVKAVKEGNVVIATLAE

SEQ ID NO: 889 - protein, 81 aa, Methanobacterium thermoautotrophicum
MERIYVIPLRKAKNVPRTIRAPKAVKIVREFLMKHMKADTVKLDESINEKLWERGIQKIPPRIKVKAVKDEDGVVEATLEE

SEQ ID NO: 890 - protein, 97 aa, Mycoplasma genitalium
MKKAIHFQSQPVVFNCASCNSNFTIDSTAKQKDLAIDICGKCHPFYIGQLTKQTVHGRAEKLSQKFNAGKAFLENKTKKSNQAKVEKQTRHRSINEL

SEQ ID NO: 891 - protein, 84 aa, Mycobacterium leprae
MKANIHPAYAETTVVCGCGNTFQTRSTKPGGRIVVEVCSQCHPFYTGKQKILDSGGRVARFEKRYGKRKVGVDQVAAYPEQNNK

SEQ ID NO: 892 - protein, 97 aa, Mycoplasma pneumoniae
MKKDFHFPSQSVSFKCASCSNSFTIESTLKQKEITIDICGKCHPFYIGELTKQTVHGRAEKLSGKFNAGKAFLENKTPKKAKGKTEEYTKHRSLNEL

SEQ ID NO: 893 - protein, 80 aa, Mycobacterium tuberculosis
MKSDIHPAYEETTVVCGCGNTFQTRSTKPGGRIVVEVCSQCHPFYTGKQKILDSGGRVARFEKRYGKRKVGADKAVSTGK

SEQ ID NO: 894 - protein, 120 aa, Nicotiana glutinosa
MSDKTKGRKEEVVTREYTINLHKRLHSCTFKKKAPTAIKEIRKFAQKAMGTKDVRVDVKLNKQIWSRGIRSVPRRVRVRIARKRNDDEDAKEELYSLVTVAEIPAKGLKGLGTKIIEDED

SEQ ID NO: 895 - protein, 81 aa, Synechocystis sp. (strain PCC 6803)
MPKADIHPTWYPDAKVTCNGEVIMTVGSTKPEINVEIWSGNHPFYTGTQKIIDTEGRVDRFMRKYGMKEKTTGDKQDKKKK

SEQ ID NO: 896 - protein, 56 aa, Bacillus stearothermophilus
AVPFRRTSKTRKRLRRTHFKLQVPGMVQCPNCGEWKLAHRVCKACGTYKGRDVVNK

SEQ ID NO: 897 - protein, 58 aa, Bacillus subtilis
AVPFRRTSKMKKRLRRTHFKLNVPGMTECPSCGEMKLSHRVCKACGSYNGKDINVKSN

SEQ ID NO: 898 - protein, 60 aa, Deinococcus radiodurans
MAKHPVPKKKTSKSKRDMRRSHHALTAPNLTECPQCHGKKLSHHICPNCGYYDGRQVLAV

SEQ ID NO: 899 - protein, 134 aa, Drosophila acanthoptera
MTIRPAYRPKIVKKRTKHFIRHQSDRYAKLSHKWRKPKGIDNRVRRRFKGQYLMPNIGYGSNKRTRHMLPTGFKKFLVHNVRELEVLLMQNREYCGEIAHGVSSNKRKEIVERAKQLSVRLTNPNARLRSQENE

SEQ ID NO: 900 - protein, 134 aa, Drosophila melanogaster
MTIRPAYRPKIVKKRTKHFIRHQSDRYAKLSHKWRKPKGIDNRVRRRFKGQYLMPNIGYGSNKRTRHMLPTGFKKFLVHNVRELEVLLMQNRVYCGEIAHGVSSKKRKEIVERAKQLSVRLTNPNGRLRSQENE

SEQ ID NO: 901 - protein, 134 aa, Drosophila pseudoobscura
MTIRPAYRPKIIKKRTKHFIRHQSDRYAKLSHKWRKPKGIDNRVRRRFKGQYLMPNIGYGSNKRTRHMLPTGFKKFLVHNVRELEVLLMQNRVYCGEIAHAVSSKKRKEIVERAKQLSIRLTNPNGRLRSQENE

SEQ ID NO: 902 - protein, 134 aa, Drosophila subobscura
MTIRPAYRPKIIKKRTKHFIRHQSDRYAKLSHKWRKPKGIDNRVRRRFKGQYLMPNIGYGSNKRTRHMLPTGFKKFLVHNVRELEVLLMQNRIYCGEIAHAVSSKKRKEIVERAKQLSIRLTNPNGRLRSQENE

SEQ ID NO: 903 - protein, 56 aa, Escherichia coli
AVQQNKPTRSKRGMRRSHDALTAVTSLSVDKTSGEKHLRHHITADGYYRGRKVIAK

SEQ ID NO: 904 - protein, 55 aa, Haemophilus influenzae
AVQQNKKSRSRRDMRRSHDALTTAAVSVDKASGETHLRHHVTADGYYRGRKVINK

SEQ ID NO: 905 - protein, 48 aa, Helicobacter pylori
MAVPDRRVSKTRAAKRRTHYSVKLAKPIKAKDGTWKLPHHINKFTKEY

SEQ ID NO: 906 - protein, 134 aa, Homo sapiens
AALRPLVKPKIVKKRTKKFIRHQSDRYVKIKRNWRKPRGIDNRVRRRFKGQILMPNIGYGSNKKTKHMLPSGFRKFLVHNVKELEVLLMCNKSYCAEIAHNVSSKNRKAIVERAAQLAIRVTNPNARLRSEENE

SEQ ID NO: 907 - protein, 58 aa, Lactococcus lactis (subsp. cremoris)
MAVPARHTSSAKKNRRRTHYKLTAPTVTFDETTGDYRHSHRVSLKGYYKGRKVRDDTK

SEQ ID NO: 908 - protein, 146 aa, Methanococcus jannaschii
MNRLLRLRFKLKMKKPDFIRQEAHRHKRLGEKWRRPKGRHSKMRLKWKEKPPVVEIGYRSPKAVRGLHPSGLEDVLVYNVKDLEKLNPETQGARIASTVGKRKKIEIIIRARELGIRILNISEEKQEELLKLAEKQEAQEVNETNE

SEQ ID NO: 909 - protein, 108 aa, Methanobacterium thermoautotrophicum
MRKKFKRQEYARYKKLGEKWRRPRGRTSKMRRYEKGKPAMPAIGYRKPSEVRGLHPSGYEDVLVSNMRELEALDPEKQAARIASAVGARKKTLMLEKARELGIKVLNP

SEQ ID NO: 910 - protein, 135 aa, Methanococcus vannielii
MSEFKRLMRLKLKMKQKRPEFKRQDSHRFQRIGTMWRRPTGHHSGQRIQVTYRLSPVKIGFRGPALVRGLHPSGLEDIIVNNVKQLAALNPKTQGARIASAVGTRKRIEIVKKANELGIRVFNVSKQKQGEFLSL

SEQ ID NO: 911 - protein, 56 aa, Mycoplasma genitalium
AVQQRRSSKHRRDKRRSHDALTLQTLSVCKKCGKKKLSHRVCSCGMYGELRVKKAH

SEQ ID NO: 912 - protein, 56 aa, Mycoplasma pneumoniae
AVQQRRSSKHRRDKRRSHDALTAQALSVCQKCGKKKLFHRVCSCGMYGDLRVKKAY

SEQ ID NO: 913 - protein, 56 aa, Synechocystis sp. (strain PCC 6803)
AVPKKKTSKAKRDQRRAHWRRQASSQAQKALSLGKSILSGRSTFLYPPAEEEGEEE

SEQ ID NO: 914 - protein, 59 aa, Thermus aquaticus (subsp. thermophilus)
AKHPVPKKKTSKARRDARRSHHALTPPILVPCPECKAMKPPHTVCPECGYYAGRKVLEV

SEQ ID NO: 915 - protein, 137 aa, Trichoderma harzianum
MVAAKKHVPIVKKHKTTFARHQSDRFDRVGSSWRKPKGIDGRVRRRFRGTIRMPKIGYGSNKKTRFLTPSGHNAFLHNARTLSCAAGCSMQSTDPSAAEIATPVSSRKRIASSPARQADRCSRSRRSKFRPRRLRAS

SEQ ID NO: 916 - protein, 49 aa, Bacillus licheniformis
MKKKVTLACKNCGSRNYTTMKSSAALAERLEVKKYCNNCNSHTVHLETK

SEQ ID NO: 917 - protein, 49 aa, Bacillus stearothermophilus
MRVNITLACTECGERNYITSKNKRNNPERLELKKYCPRDRKVTLHRETK

SEQ ID NO: 918 - protein, 49 aa, Bacillus subtilis
MRKKITLACKTCGNRNYTTMKSSASAAERLEVKKYCSTCNSHTAHLETK

SEQ ID NO: 919 - protein, 54 aa, Escherichia coli
AKGIREKIKLVSSAGTGHFYTTTKNKRTKPEKLELKKFDPVVRQHVIYKEAKIK

SEQ ID NO: 920 - protein, 56 aa, Haemophilus influenzae
MAAKGAREKIRLVSTAETGHFYTTDKNKRNMPEKMEIKKFDPVVRKHVIYKEAKIK

SEQ ID NO: 921 - protein, 52 aa, Helicobacter pylori
MKVKIGLKCSDCEDINYSTTKNAKTNTEKLELKKFCPRENKHTLHKEIKLKS

SEQ ID NO: 922 - protein, 48 aa, Lactococcus lactis (subsp. lactis)
MRVKITLICSSCGNKNYISSKNKATHPEKVETMKFCPKERIVTLHREG

SEQ ID NO: 923 - protein, 49 aa, Lactococcus lactis (subsp. cremoris)
MRVNITLEHKESGERLYLTQKNKRNTPDKLELKKYSKKLRKHVIFKEVK

SEQ ID NO: 924 - protein, 53 aa, Mycoplasma capricolum
MRSSTNKKATLVCVECLSRNYSVNKSGLTQKQRLEIKKFCTTCNAHTLHKETR

SEQ ID NO: 925 - protein, 53 aa, Mycoplasma genitalium
MAVKRSTRLGCNECSEINYLTFKNVKKNPEKLALNKFCSRCRKVVLHKEVKRK

SEQ ID NO: 926 - protein, 53 aa, Mycoplasma pneumoniae
MAVKRSTRLGCNDCREINYLTFKNVKKNPEKLALNKFCSRCRKVVVHKEVKRK

SEQ ID NO: 927 - protein, 55 aa, Mycobacterium tuberculosis
MASSTDVRPKITLACEVCKHRNYITKKNRRNDPDRLELKKFCPNCGKHQAHRETR

SEQ ID NO: 928 - protein, 65 aa, Synechocystis sp. (strain PCC 6803)
MAKKGKGARLVITLECTECRSNPDKRSNGVNRYTTMKNRRNTTARLELKKFCTHCNKHTIHKETK

SEQ ID NO: 929 - protein, 49 aa, Thermotoga maritima
MRVKVALKCSQCGNKNYYTTRNKDKRAKLELRKYCPKCNAHTIHTETKA

SEQ ID NO: 930 - protein, 54 aa, Thermus aquaticus (subsp. thermophilus)
MASEVRIKLLLECTECKRRNYATEKNKRNTPNKLELRKYCPWCRKHTVHREVKI

SEQ ID NO: 931 - protein, 129 aa, Aedes albopictus
VQRLTLRRRLSYNTKSNKRRVVRTPGGRLVYLYVKKQRTVPKCGQCKEKLSGIKPSRPSERPRMCRRLKTVTRTFGGVLCHRCLRERIIRAFLIDEQKVVKVLKAQQLGKPVSKPPKIQKTAKAASKSK

SEQ ID NO: 932 - protein, 120 aa, Arabidopsis thaliana [sequence omitted]

SEQ ID NO: 933 - protein, 44 aa, Bacillus stearothermophilus
MKRTYQPNRRKRSKVHGFRARMSTKNGRKVLARRRRKGRKVLSA

SEQ ID NO: 934 - protein, 44 aa, Bacillus subtilis
MKRTFQPNNRKRSKVHGFRSRMSSKNGRLVLARRRRKGRKVLSA

SEQ ID NO: 935 - protein, 51 aa, Borrelia burgdorferi
MKRTYQPSRVKRNRKFGFRARMKTKGGRLILSRRRAKGRMKLTVSDEKKKY

SEQ ID NO: 936 - protein, 47 aa, Buchnera aphidicola
MKRTFQPSILKRNRSHGFRTRMATKNGRYILSRRRAKLRTRLTVSSK

SEQ ID NO: 937 - protein, 44 aa, Coxiella burnetii
MKRTYQPSKQKRNRTHGFRARMATKNGRQVLNRRRAKGRKRLTV

SEQ ID NO: 938 - protein, 46 aa, Escherichia coli [sequence omitted]

SEQ ID NO: 939 - protein, 44 aa, Haemophilus influenzae
MKRTFQPSVLKRSRTHGFRARMATKNGRQVLARRRAKGRKSLSA

SEQ ID NO: 940 - protein, 44 aa, Helicobacter pylori
MKRTYQPHNTPRKRTHGFLVRMKTKNGRKVINARRAKGRKKLSV

SEQ ID NO: 941 - protein, 116 aa, Homo sapiens
VQRLTYRRRLSYNTASNKTRLSRTPGNRIVYLYTKKVGKAPKSACGVCPGKLRGVRPVRPKVLMRLSKTKKHVSRAYGGSMCAKCVRDRIKRAFLIEEQKIIVKVLKAQAQSQKAK

SEQ ID NO: 942 - protein, 89 aa, Methanococcus jannaschii
MPAPRYRSRSYRRIYRRTPGGRIVIHYKRRKPGKPKCAICGAELHGVPRGRPVEIRKLPKSQRRPERPYGGYLCPRCLKRLMIQKARNL

SEQ ID NO: 943 - protein, 88 aa, Methanobacterium thermoautotrophicum
MPELRYRSRSYKRIFKKTPGGRTVTHYRRKKPSKHVCAGCGKPLHGVPRGRPYEIRKLSKSKKRPNRPYGGYYCSSCARKVFKKEARS

SEQ ID NO: 944 - protein, 45 aa, Micrococcus luteus
MTKRTFQPNNRRRARKHGFRARMRTRAGRAILSARRGKNRAELSA

SEQ ID NO: 945 - protein, 44 aa, Mycoplasma capricolum
MKRTWQPSKLKHARVHGFRARMATKNGRKVIKARRAKGRVRLSA

SEQ ID NO: 946 - protein, 48 aa, Mycoplasma genitalium
MKRTYQPSKLKRAKTHGFMARMATAQGRKVLRQRRFKNRAQLTVSSER

SEQ ID NO: 947 - protein, 47 aa, Mycobacterium leprae
MRKGKRTFQPNNRRRARVHGFRLRMRTRAGRSIVSDRRRKGRRTLTA

SEQ ID NO: 948 - protein, 48 aa, Mycoplasma pneumoniae
MKRTYQPSKLKRAKTHGFLARMATASGRKVLKLRRKKQRAQLTVSSER

SEQ ID NO: 949 - protein, 47 aa, Mycobacterium smegmatis
MAKGKRTFQPNNRRRALIHGFRARMRTRADRAIVAHRRSKGRRAPTA

SEQ ID NO: 950 - protein, 47 aa, Mycobacterium tuberculosis
MTKGKRTFQPNNRRRARVHGFRLRMRTRAGRSIVSSRRRKGRRTLSA

SEQ ID NO: 951 - protein, 120 aa, Pisum sativum
MVQRLTYRRRHSYATKSNQHRVVKTPGGKLVYQTTKKRASGPKCPVTGKRIQGIPHLRPTEYKRSRLSRNRRTVNRAYGGVLSGGAVRERIIRAFLVEEQKIVKKVLKIQKTKEKQAAKN

SEQ ID NO: 952 - protein, 47 aa, Proteus mirabilis
MKRTFQPSVLKRNRNHGFRARMATKNGRQVLARRRAKGRARLTVSSK

SEQ ID NO: 953 - protein, 44 aa, Pseudomonas putida
MKRTFQPSTIKRARTHGFRARMATKNGRAVLSRRRAKGRKRLAI

SEQ ID NO: 954 - protein, 116 aa, Rattus norvegicus
VQRLTYRRRLSYNTASNKTRLSRTPGNRIVYLYTKKVGKAPKSACGVLPGRLRGVVAVRPKVLMRLSKTKKHVQQGLWWLHVRQVCPDRIKRAFLIEEQKIVVKVLKAQAQSQKAK

SEQ ID NO: 955 - protein, 45 aa, Streptomyces bikiniensis
MSKRTFQPNNRRRAKTHGFRLRMRTRAGRAILANRRAKGRASLSA

SEQ ID NO: 956 - protein, 45 aa, Streptomyces coelicolor
MSKRTFQPNNRRRAKTHGFRLRMRTRAGRAILATRRSKGRARLSA

SEQ ID NO: 957 - protein, 87 aa, Sulfolobus acidocaldarius
MPSPQQRSGSFRKVFVKLPSGKSTIHYERRKDNIARCGMCKKPLNGVKNNYTYKYSKTEKRPERVYGGYLCHKCLESLIKMTIRGIS

SEQ ID NO: 958 - protein, 45 aa, Synechocystis sp. (strain PCC 6803)
MTQRTLGGTNRKQKRTSGFRARMRTHNGRKVIQARRSKGRHRLAV

SEQ ID NO: 959 - protein, 120 aa, Nicotiana tabacum
MVQRLTYRKRHSYATKSNQHRVVKTPGGKLIYQSTKKRASGPKCPVTGKRIQGIPHLRPTEYKRSRLSRNRRTVNRAYGGVLSGSAVRERIIRAFLVEEQKIVKKVLKIQKAKEKLAAKS

SEQ ID NO: 960 - protein, 112 aa, Saccharomyces cerevisiae
AGLKDVVTREYTINLHKRLHGVSFKKRAPRAVKEIKKFAKLHMGTDDVRLAPELNQAIWKRGVKGVEYRLRLRISRKRNEEEDAKNPLFSYVEPVLVASAKGLQTVVVEEDA

SEQ ID NO: 961 - protein, 123 aa, Babesia bovis
MEKIKVYELRNKTDAELLKQLEDLKQEYASMRVQKVTVTSTSKLSQIGVIRKAIAKVLTVYNQRKREEARKQYTKISEMPLNMRPKLTRAKRRALTPKQLHLKTIKQRKKCENFPKRKYALLV

SEQ ID NO: 962 - protein, 65 aa, Bacillus stearothermophilus
PKMKTHRGSAKRFKKTASGKLKRGHAYTSHLFANKTKKQKRHLRKATLVSPGDFKRIRQMLDNLK

SEQ ID NO: 963 - protein, 65 aa, Bacillus subtilis
PKMKTHRGSAKRFKKTGSGKLKRSHAYTSHLFANKSQKQKRKLRKSAVVSAGDFKRIKQMLANIK

SEQ ID NO: 964 - protein, 65 aa, Buchnera aphidicola
MPKIKTLRSAAKRFKKTASGKFKRKQANLRHILTKKTTTKKRHLRPKILVSKGDISKVKSFLPYF

SEQ ID NO: 965 - protein, 123 aa, Caenorhabditis elegans
MTKLKCKSLRGEKKDALQKKLDEQKTELATLRVSKVTGGAASKLSKIRVVRKNIARLLTVINQTQKQELRKFYADHKYKPIDLRLKKTRAIRRRLTAHELSLRSAKQQAKSRNQAVRKFAVKA

SEQ ID NO: 966 - protein, 64 aa, Escherichia coli
PKIKTVRGAAKRFKKTGKGGFKHKHANLRHILTKKATKRKRHLRPKAMVSKGDLGLVIACLPYA

SEQ ID NO: 967 - protein, 64 aa, Haemophilus influenzae
PKIKTVRGAAKRFKKTASGGFKRKQSHLRHILTKKTTKRKRHLRHKSMVAKADQVLVVACLPYA

SEQ ID NO: 968 - protein, 64 aa, Helicobacter pylori
MPKMKTNRGASKRFKVKKNLIKRGSAFKSHILTKKSPKRKANLNAPKHVHHTNAHSVMSLLCRA

SEQ ID NO: 969 - protein, 122 aa, Homo sapiens [sequence omitted]

SEQ ID NO: 970 - protein, 61 aa, Mycoplasma fermentans
PKMKTKSALKKRIKITGTGKIMREQAYRSHLSQNKTTKQKRQARKSVQMHSSDVKRFKALI

SEQ ID NO: 971 - protein, 59 aa, Mycoplasma genitalium
MKTKSAAVKRFKLTKSGQIKRKHAYTSHLAPHKSTKQKRHLRKQATVSNSELKRIGILI

SEQ ID NO: 972 - protein, 59 aa, Mycoplasma pneumoniae
MKVKSAAKKRFKLTKSGQIKRKHAYTSHLAPHKTTKQKRHLRKQGTVSASDFKRIGNLI

SEQ ID NO: 973 - protein, 64 aa, Pseudomonas syringae
MPKMKTKSGAAKRFLKTANGIKHKHAFKSHILTKMSTKRKRQLRGSSLLHPSDVAKVERMLRLR

SEQ ID NO: 974 - protein, 122 aa, Rattus norvegicus
AKIKARDLRGKKKEELLKQLDDLKVELSQLRVAKVTGGAASKLSKIRVVRKSIARVLTVINQTQKENLRKFYKGKKYKPLDLRPKKTRAMRRRLTKHEEKLKTKKQQRKERLYPLRKYAVKA

SEQ ID NO: 975 - protein, 67 aa, Synechocystis sp. (strain PCC 6803)
MPKLKTRKAAAKRFRPTGSGKKIIRRKAFKNHLLEHKSSEQKHRRLSNLALVHEADEKNVRLMLPYM

SEQ ID NO: 976 - protein, 120 aa, Saccharomyces cerevisiae
MAGVKAYELRTKSKEQLASQLVDLKKELAELKVQKLSRPSLPKIKTVRKSIACVLTVINEQQREAVRQLYKGKKYQPKDLRAKKTRALRRALTKFEASQVTEKQRKKQIAFPQRKYAIKA

SEQ ID NO: 977 - protein, 37 aa, Bacillus stearothermophilus
MKVRPSVKPICEKCKVIRRRGKVMVICENPKHKQRQG

SEQ ID NO: 978 - protein, 37 aa, Bacillus subtilis
MKVRPSVKPICEKCKVIRRKGKVMVICENPKHKQKQG

SEQ ID NO: 979 - protein, 104 aa, Caenorhabditis elegans
MSGPGIEGLAVGLNKGHAATQLPVKQRQNRHKGVASKKTKIVRELVREITGFAPYERRVLEMLRISKDKRALKFLKRRIGTHRRAKGKREELQNVIIAQRKAHK

SEQ ID NO: 980 - protein, 99 aa, Candida albicans
MAKSGIAAGVNKGRKTTAKEVAPKISYRKGASSQRTVFVRSIVKEVAGLAPYERRLIELIRNAGEKRAKKLAKKRLGTHKRALRKVEEMTQVIAESRRH

SEQ ID NO: 981 - protein, 37 aa, Chlamydia trachomatis
MKVRASIKRICKDCKIIKRHGVNRVICINFKHKQRQG

SEQ ID NO: 982 - protein, 115 aa, Drosophila melanogaster
MAVRYELAIGLNKGHKTSKIRNVKYTGDKKVKGLRGSRLKNIQTRHTKFMRDLVREVVGHAPYEKRTMELLKVSKDKRALKFLKRRLGTHIRAKRKREELSNILTQLRKAQTHAK

SEQ ID NO: 983 - protein, 38 aa, Escherichia coli [sequence omitted]

SEQ ID NO: 984 - protein, 37 aa, Haemophilus influenzae
MKVRASVKKMCRNCKIVKREGVVRVLCSDPKHKQRQG

SEQ ID NO: 985 - protein, 37 aa, Helicobacter pylori
MKVRPSVKKMCDNCKIIKRRGVIRVICATPKHKQRQG

SEQ ID NO: 986 - protein, 38 aa, Lactococcus lactis (subsp. lactis)
MKVRPSVKPICEYCKVIRRNGRVMVICPANPKHKQRQG

SEQ ID NO: 987 - protein, 104 aa, Mus musculus
ALRYPMAVGLNKGHKVTKNVSKPRHSRRRSRLTNHTKFVRDMIREVCGFAPYERRAMELLKVSKSKRALKFIKKRVGTHIRAKRKREELSNVLAAMEEAAAKKD

SEQ ID NO: 988 - protein, 37 aa, Mycoplasma genitalium
MKVRASVKPICKDCKIIKRHRILRVICKTKKHKQRQG

SEQ ID NO: 989 - protein, 37 aa, Mycoplasma pneumoniae
MKVRASVKPICKDCKIIKRHQIVRVICKTQKHKQRQG

SEQ ID NO: 990 - protein, 37 aa, Mycobacterium tuberculosis
MKVNPSVKPICDKCRLIRRHGRVMVICSDPRHKQRQG

SEQ ID NO: 991 - protein, 104 aa, Rattus norvegicus
ALRYPMAVGLNKGHKVTKNVSKPRHSRRRGRLTKHTKFVRDMIREVCAFAPYERRAMELLKVSKDKRALKFIKKRVGTHIRAKRKREELSNVLAAMRKAAAKKD

SEQ ID NO: 992 - protein, 37 aa, Synechococcus sp. (strain PCC 6301)
MKVRASVRKICEKCRVIKRRGRVMVICANPKHKQRQG

SEQ ID NO: 993 - protein, 38 aa, Synechocystis sp. (strain PCC 6803)
MKVRASVKKMCDKCRVIRRRGRVMVICSANPKHKQRQG

SEQ ID NO: 994 - protein, 37 aa, Thermus aquaticus (subsp. thermophilus)
MKVRASVKRICDKCKVIRRHGRVYVICENPKHKQRQG

SEQ ID NO: 995 - protein, 37 aa, Vibrio cholerae
MKVRASVKKICRNCKVIKRNGVVRVICSEPKHKQRQG

SEQ ID NO: 996 - protein, 95 aa, Arabidopsis thaliana
MGKGTASFGKRRNKSHTLCVRCGRRSFHIQKSRCSACAYPAARKRTYNWSVKAIRRKTTGTGRMRYLRNVPRRFKTCFREGTQATPRNKAAASSS

SEQ ID NO: 997 - protein, 91 aa, Caenorhabditis elegans
MTKGTQAFGKKHVKSHTLCKRCGKSSFHIQKKRCASCGYQDAKKRTYNWGAKSIRRRTTGTGRTRHLRDVNARFRNGFRGTTPKPRAQPTN

SEQ ID NO: 998 - protein, 56 aa, Haloarcula marismortui
TGAGTPSQGKKNTTTHTKCRRCGEKSYHTKKKVCSSCGFGKSAKRRDYEWQSKAGE

SEQ ID NO: 999 - protein, 96 aa, Homo sapiens
TKGTSSFGKRRNKTHTLCRRCGSKAYHLQKSTCGKCGYPAKRKRKYNWSAKAKRRNTTGTGRMRHLKIVYRRFRHGFREGTTPKPKRAAVAASSSS

SEQ ID NO: 1000 - protein, 82 aa, Leishmania infantum
TKGTTSMGQRHGRTHILCRRCGRNSYHVQWERCAACAYPRASRRRYNWSVKAIKRRRTGTGRCRYLKVVNRRIANHFKTPKA

SEQ ID NO: 1001 - protein, 61 aa, Methanococcus jannaschii
MSKGTPSMGKRNKGSYHIRCRRCGRRAYHVRKKRCAACGFPNKRMRKYSWQNKKVNGKRIK

SEQ ID NO: 1002 - protein, 69 aa, Arabidopsis thaliana [sequence omitted]

SEQ ID NO: 1003 - protein, 69 aa, Homo sapiens [sequence omitted]

SEQ ID NO: 1004 - protein, 69 aa, Lycopersicon esculentum
MPKQIHEIKDFLLTARRKDARTVKIKKNKDMVKFKVRCSKYLYTLCVSDFEKADKLKQSLPPGLSVQDL

SEQ ID NO: 1005 - protein, 74 aa, Schizosaccharomyces pombe
MPRQVTDIKLFLQLAHRGDATSARVKKNQNKAVKFKLRCSRYLYTLVVADAKKAEKLRQSLPPALTVTEVGKKA

SEQ ID NO: 1006 - protein, 78 aa, Saccharomyces cerevisiae
MAREITDIKQFLELTRRADVKTATVKINKKLNKAGKPFRQTKFKVRGSSSLYTLVINDAGKAKKLIQSLPPTLKVNRL

SEQ ID NO: 1007 - protein, 51 aa, Arabidopsis thaliana
MPSHKSFMIKKKLGKKMRQNRPIPHWIRLRTDNTIRYNAKHRHWRRTKLGF

SEQ ID NO: 1008 - protein, 50 aa, Archaeoglobus fulgidus
MGKKTVGVKKRLAKAYKQNRRAPVWITVKTKRSVFGSPKRRHWRRSKLKV

SEQ ID NO: 1009 - protein, 51 aa, Caenorhabditis elegans
MSALKKSFIKRKLAKKQKQNRPMPQWVRMKTGNTMKYNAKRRHWRRTKLKL

SEQ ID NO: 1010 - protein, 51 aa, Drosophila melanogaster
MAAHKSFRIKQKLAKKLKQNRSVPQWVRLATGNTIRYNAKRRHWRRTKLKL

SEQ ID NO: 1011 - protein, 49 aa, Haloarcula marismortui
GKKSKATKKRLAKLDNQNSRVPAWVMLKTDREVQRNHKRRHWRRNDTDE

SEQ ID NO: 1012 - protein, 50 aa, Homo sapiens [sequence omitted]

SEQ ID NO: 1013 - protein, 51 aa, Zea mays
MPSHKTFRIKKKLAKKMRQNRPIPYWIRMRTDNTIRYNAKRRHWRRTKLGF

SEQ ID NO: 1014 - protein, 52 aa, Methanococcus jannaschii
MMGSNKPLGKKVRLAKALKQNRRVPLFVIVKTRGRVRFHPKMRYWRRKKLKA

SEQ ID NO: 1015 - protein, 51 aa, Methanobacterium thermoautotrophicum
MSRNKHVARKLRMAKANRQNRRVPAWVMVKTNYRVRSHPKMRHWRRTKLKV

SEQ ID NO: 1016 - protein, 50 aa, Sulfolobus solfataricus
SKHKSLGKKLRLGKALKRNSPIPAWVIIKTQAEIRFNPLRRNWRRNNLKV

SEQ ID NO: 1017 - protein, 99 aa, Saccharomyces cerevisiae
TVKTGIAIGLNKGKKVTSMTPAPKISYKKGAASNRTKFVRSLVREIAGLSPYERRLIDLIRNSGEKRARKVAKKRLGSFTRAKAKVEEMNNIIAASRRH

SEQ ID NO: 1018 - protein, 155 aa, Saccharomyces cerevisiae
MKVEIDSFSGAKIYPGRGTLFVRGDSKIFRFQNSKSASLFKQRKNPRRIAWTVLFRKHHKKGITEEVAKKRSRKTVKAQRPITGASLDLIKERRSLKPEVRKANREEKLKANKEKKKAEKAARKAEKAKSAGTQSSKFSKQQAKGAFQKVAATSR

SEQ ID NO: 1019 - protein, 155 aa, Saccharomyces cerevisiae
MKVEVDSFSGAKIYPGRGTLFVRGDSKIFRFQNSKSASLFKQRKNPRRIAWTVLFRKHHKKGITEEVAKKRSRKTVKAQRPITGASLDLIKERRSLKPEVRKANREEKLKANKEKKRAEKAARKAEKAKSAGVQGSKVSKQQAKGAFQKVAATSR

SEQ ID NO: 1020 - protein, 110 aa, Methanococcus jannaschii
MRRRENMDVNKAIRTAVDTGKVILGSKRTIKFVKHGEGKLVVLAGNIPKDLEEDVKYYAKLSNIPVYQHKITSLELGAVCGKPFPVAALLVLDEGLSNIMELVEKKEGGE

SEQ ID NO: 1021 - protein, 105 aa, Methanococcus vannielii
MRRRYSMDINRAIRVAVDTGNVVLGTKQAIKNIKHGEGKLVIIAGNCAKDVKEDIFYYTKLSETPVYTHQVTSIELGAICGKPFPVSALLVLEPGNSAILNINNE

SEQ ID NO: 1022 - protein, 104 aa, Sulfolobus acidocaldarius
MSQSFEGELKTLLRSGKVILGTRKTLKLLKTGKVKGVVVSSTLRQDLKDDIMTFSKFSDIPIYLYKGSGYELGTLCGKPFMVSVIGIVDEGESKILEFIKEVKQ

SEQ ID NO: 1023 - protein, 101 aa, Thermococcus celer
MVDFAFELRKAQDTGKIVMGARKSIQYAKMGGAKLIIVARNARPDIKEDIEYYARLSGIPVYEFEGTSVELGTLLGRPHTVSALAVVDPGESRILALGGKE

SEQ ID NO: 1024 - protein, 104 aa, Saccharomyces cerevisiae
APVKSQESINQKLALVIKSGKYTLGYKSTVKSLRQGKSKLIIIAANTPVLRKSELEYYAMLSKTKVYYFQGGNNELGTAVGKLFRVGVVSILEAGDSDILTTLA

SEQ ID NO: 1025 - protein, 134 aa, Mus musculus
AALRPLVKPKIVKKRTKKFIRHQSDRYVKIKWNWRKPRGIDNRVRRRFKGQILMPNIGYRSNKKTKHTLSSGFRKFLVHNIKEPEVLLMCNKSYRAEIAHNVSSKNRKAIVERAAQLAIRVTNPNTRLHSEENE

SEQ ID NO: 1026 - protein, 130 aa, Saccharomyces cerevisiae
MASLPHPKIVKKHTKKFKRHHSDRYHRVAENWRKQKGIDSVVRRRFRGNISQPKIGYGSNKKTKFLSPSGHKTFLVANVKDLETLTMHTKTYAAEIAHNISAKNRVVILARAKALGIKVTNPKGRLALEA

SEQ ID NO: 1027 - protein, 52 aa, Acanthamoeba castellanii
VIEPSLQVLARKYNCDKVVCRKCYARLHPRAVNCRKKKCGHSNHWRPKKKLK

SEQ ID NO: 1028 - protein, 52 aa, Arabidopsis thaliana
IIEPSLMMLARKYNQDKMICRKCYARLHPRAVNCRKKKCGHSNQLRPKKKIK

SEQ ID NO: 1029 - protein, 52 aa, Brassica rapa
IIEPSLMALARKYNQAKMICRKCYARLHPRAVNCRKKKCGHSNQLRPKKKIK

SEQ ID NO: 1030 - protein, 52 aa, Caenorhabditis elegans
IIEPSLRQLAQKYNCDKQICRKCYARLPPRASNCRKKKCGHSSELRIKKKLK

SEQ ID NO: 1031 - protein, 52 aa, Chlamydomonas reinhardtii
IIEPSLQALARKYNQEKMICRKCYARLHPRAKNCRKKSCGHTNQLRPKKKLK

SEQ ID NO: 1032 - protein, 53 aa, Cryptococcus neoformans
IIEPSLKALASKYNCEKQICRKCYARLPPRATNCRKRKCGHSSQIRPKKALKK

SEQ ID NO: 1033 - protein, 52 aa, Dictyostelium discoideum
IEPSLVILARKYKCDKMICRKCYARLHPRAVNCRKKKCGHSNNLRPKKKLLK

SEQ ID NO: 1034 - protein, 52 aa, Drosophila melanogaster
IIEPSLRILAQKYNCDKMICRKCYARLHPRATNCRKKKCGHTNNLRPKKKLK

SEQ ID NO: 1035 - protein, 53 aa, Eimeria bovis
IIEPSLALLASKYNCEKKICRKCYARLPPRATNCRKKKCGHTSQLRPKKKPKN

SEQ ID NO: 1036 - protein, 52 aa, Homo sapiens [sequence omitted]

SEQ ID NO: 1037 - protein, 52 aa, Leishmania major
VMEPTLVALAKKYNWEKKVCRRCYARLPVRATNCRKKACGHCSNLRMKKKLR

SEQ ID NO: 1038 - protein, 47 aa, Methanococcus jannaschii
MPFEEAMKRLFMKKICMRCNARNPWRATKCRKCGYKGLRPKAKEPRG

SEQ ID NO: 1039 - protein, 48 aa, Methanobacterium thermoautotrophicum
MARFEEAENRLFNIKICLKCNARNPPTAKTCRKCGYKGLRYKAKEPRG

SEQ ID NO: 1040 - protein, 52 aa, Nicotiana sylvestris
IIEPSLMALARKYNQDKMICRKCYARLHPRAVNCRRKKCGHSNQLRPKKKIK

SEQ ID NO: 1041 - protein, 53 aa, Oryza sativa
IIEPSLQALARKYNQDKMICRKCTARLHPRAVNCRKKKCGHSNQLRPKKKIKN

SEQ ID NO: 1042 - protein, 53 aa, Tetrahymena pyriformis
GMEPTIAALAKKYNCEKKVCRDCYARLPPKATNCRKRKCGHSNSLRLKKKPKE

SEQ ID NO: 1043 - protein, 72 aa, Nicotiana tabacum
IIEPSLKALASKFNCDKMICRKCYVRCPRRTPQRTCRVLTWIPQARLPPRATNCRKRKCGHTNHVRPKKKLK

SEQ ID NO: 1044 - protein, 52 aa, Trypanosoma brucei brucei
VMEPTLEALAKKYNWEKKVCRRCYARLPVRATNCRKKGCGHCSNLRMKKKLR

SEQ ID NO: 1045 - protein, 52 aa, Trypanosoma cruzi
VMEPTLEALAKKYNWEKKVCRRCYARLPVRASNCRKKACGHCSNLRMKKKLR

SEQ ID NO: 1046 - protein, 52 aa, Saccharomyces cerevisiae
IIEPSLKALASKYNCDKSVCRKCYARLPPRATNCRKRKCGHTNQLRPKKKLK

SEQ ID NO: 1047 - protein, 25 aa, Agaricus bisporus
MREKWKKKRSRRLRRKRRKMRARSK

SEQ ID NO: 1048 - protein, 25 aa, Homo sapiens [sequence omitted]

SEQ ID NO: 1049 - protein, 22 aa, Methanococcus jannaschii
MRWKWYKKRLRRLKRERKRARS

SEQ ID NO: 1050 - protein, 25 aa, Nicotiana tabacum
MRAKWKKKRMRRLKRKRRKMRQRSK

SEQ ID NO: 1051 - protein, 25 aa, Saccharomyces cerevisiae
MRAKWRKKRTRRLKRKRRKVRARSK

SEQ ID NO: 1052 - protein, 58 aa, Saccharomyces cerevisiae
AKSKNHTAHNQTRKAHRNGIKKPKTYKYPSLKGVDPKFRRNHKHALHGTAKALAAAKK

SEQ ID NO: 1053 - protein, 105 aa, Arabidopsis thaliana
MVNIPKTKNTYCKNKECKKHTLHKVTQYKKGKDSLAAQGKRRYDRKQSGYGGQTKPVFHKKAKTTKKIVLRLQCQSCKHFSQRPIKRCKHFEIGGDKKGKGTSLF

SEQ ID NO: 1054 - protein, 105 aa, Brugia malayi
MVNVPKTRRTFCDGKCRRHTMHKVTQYKKGKESRLAQGRRRYDSKQKGFGGQTKPIFRKKAKTTKKIVLRMECTECKHRKQLPIKRCKHFELGGQKKTRGQVIQF

SEQ ID NO: 1055 - protein, 104 aa, Caenorhabditis elegans
VNVPKARRTFCDGKCRKHTNHKVTQYKKGKESKFAQGRRRYDRKQSGFGGQTKPIFRKKAKTTKKIVLRMECTECKHKKQLPIKRCKHFELGGQKKSRGQVIQF

SEQ ID NO: 1056 - protein, 105 aa, Candida tropicalis
VNIPKTRNTYCKGKGCRKHTIHKVTQYKAGRASLFAQGKRRYDRKQSGYGGQTKQVFHKKAKTTKKIVLKLECTVCKTKKQLPLKRCKHIELGGEKKQKGQALQF

SEQ ID NO: 1057 - protein, 98 aa, Chlamydomonas reinhardtii
VNVPKTKRAFCKGCKKHMMMKVTQYKTGKASLYAQGKRRYDRKQSGYGGQTKPVFHKKAKTTKKIVLRMQCQECKQTCMKGLKRCKHFEIGGDKKKGN

SEQ ID NO: 1058 - protein, 105 aa, Debaryomyces occidentalis
VNVPKTRKTYCKGKECRKHTQHKVTQYKAGKASLFAQGKRRYDRKQRGYGGQTKQIFHKKAKTTKKVVLKLECVVCKTKAQLSLKRCKHFELGGDKKQKGQALQF

SEQ ID NO: 1059 - protein, 104 aa, Gossypium hirsutum
VNVPKTKKTYCKSKECRKHTLHKVTQYKKGKDSLAAQGKRRYDRKQSGYGGQTKPVFHKKAKTTKKIVLRLQCQGCKHVSQHPIKRCKHFEIGGDKKGKGTSLF

SEQ ID NO: 1060 - protein, 92 aa, Haloarcula marismortui
MQMPRRFNTYCPHCNEHQEHEVEKVRSGRQTGMKWIDRQRERNSGIGNDGKFSKVPGGDKPTKKTDLKYRCGECGKAHLREGWRAGRLEFQE

SEQ ID NO: 1061 - protein, 105 aa, Homo sapiens
VNVPKTRRTFCKKCGKHQPHKVTQYKKGKDSLYAQGKRRYDRKQSGYGGQTKPIFRKKAKTTKKIVLRLECVEPNCRSKRMLAIKRCKHFELGGDKKRKGQVIQF

SEQ ID NO: 1062 - protein, 105 aa, Kluyveromyces lactis
VNVPKTRKTYCKGKECRKHAQHKVTQYKAGKASLYAQGKRRYDRKQSGFGGQTKQIFHKKAKTTKKVVLRLECMSCKTKTQLALKRCKHFELGGEKKQKGQALQF

SEQ ID NO: 1063 - protein, 105 aa, Kluyveromyces marxianus
VNVPKTRKTYCKGKACRKHSQHKVTQYKAGKASLYAQGKRRYDRKQSGFGGQTKQIFHKKAKTTKKVVLRLECMSCKTKTQLALKRCKHFELGGEKKQKGQALQF

SEQ ID NO: 1064 - protein, 94 aa, Methanococcus jannaschii
MKIPKKVRRYCPYCKKHTIHIVEKAKKGKPSELTWGQRQFRRVTAGYGGFPRPLPDRSKPVKKIDLRFKCTECGKMHTKANGCFRSGRFEFVEK

SEQ ID NO: 1065 - protein, 92 aa, Methanobacterium thermoautotrophicum
MKIPKERRTYCPNCRKHTVHEVLESKRRKASELKWGQRQFRRVTAGYRGYPRPLPSGNKPVKKLDLRLKCKECGKSHIKKKSFRAGRVEYVA

SEQ ID NO: 1066 - protein, 102 aa, Pichia gilliermondii
VNVPKTRRTYCKGKDCRKHTQHKVTQYKAGKASLFAQGKRRYDRKQSGFGGQTKPVFHKKAKTTKKVVLRLECVVCKTKAQLSLKRCKHFELGGDKKQKGQA

SEQ ID NO: 1067 - protein, 105 aa, Pichia jadinii
VNVPKTRRTYCKGKECRKHTQHKVTQYKAGKASLFAQGKRRYDRKQSGYGGQTKPVFHKKAKTTKKVVLRLECVVCKTKAQLALKRCKHFELGGDKKQKGQALQF

SEQ ID NO: 1068 - protein, 106 aa, Trypanosoma brucei brucei
MVNYPKKKKMHCPDERCNAHKSFKVVQYKAGKARLYARGKRRYDRKQSGYGGQTKPIFHKKAKTTKKIVLKLQCSNCKSIIQNVLKRTKHFELNDKKKTGNKDPTW

SEQ ID NO: 1069 - protein, 105 aa, Saccharomyces cerevisiae
VNVPKTRKTYCKGKTCRKHTQHKVTQYKAGKASLFAQGKRRYDRKQSGFGGQTKPVFHKKAKTTKKVVLRLECVKCKTRAQLTLKRCKHFELGGEKKQKGQALQF

SEQ ID NO: 1070 - protein, 50 aa, Kluyveromyces marxianus
AAKKSFIIKQKLAKAKNQNRPLPQWFRLKTNNTIRYNAKRRHWRRTKLVC

SEQ ID NO: 1071 - protein, 50 aa, Saccharomyces cerevisiae
AAQKSFRIKQKMAKAKKQNRPLPQWIRLRTNNTIRYNAKRRNWRRTKMNI

SEQ ID NO: 1072 - protein, 155 aa, Chlamydia trachomatis
MQIPVLKKIVISMGLAEAAKDKNLFQAHLEELAVISGQKPLVTRAKNSIAGFKLREGQGIGAKVTLRGIRMYDFMDRFCNIVSPRIRDFRGFSCKGDGRGCYSLGLDDQQIFPEVDLDAVKRSQGMNITWVTTAQTDAECLTLLECMGLRFKKAQ

SEQ ID NO: 1073 - protein, 168 aa, Methanobacterium thermoautotrophicum
MNPMEEVRIFKVTLNIGVGEGGEKLARAERLLEEMSGQKPVRTHSKVTNPEFGIRKKQPIACKVTLRGERAEKVLKMFLEGIGNRLKASQFDEYGNVSMGIDEHIDIPGMKYDPEIGIFGMNLSVTFEKPGHRINRRRIQRRKVPQKHRVSREEAIEFMKEKFQVKIV

SEQ ID NO: 1074 - protein, 170 aa, Thermoplasma acidophilum
MNPMEEVIIDKVVVNIGVGQAGDRLTKAAKVLEMLTGHKATNTLAKKSIRDFNIRKRLPIGVKVTLRKKDAMEFLQKAFYVKDYKITDYSFDKHGNAYFGISDYTDFKGMKYDPDIGIFGMDVAIVFRRRGGYRIERRRIGSKTIPNSIRVRKEEAQDFLQKNFKVTVVR

SEQ ID NO: 1075 - protein, 177 aa, Acyrthosiphon kondoi symbiotic bacterium
MSRVAKAPVVIPAGVEVKLNGQVISIKGKNGELTRTVHDAVIVKQEANALNFRPREGFRNAWAQAGTTRALLNAMVVGVTEGFTKKLQLVGVGYRAAVKGNVVNLALGFSHPIEHQLPAGITAECPSQTEIVLKGVDKQVIGQAAADLRAYRRPEPYKGKGVRYADEVVRTKEAKKK

SEQ ID NO: 1076 - protein, 177 aa, Bacillus stearothermophilus
SRVGKKPIEIPAGVTVTVNGNTVTVKGPKGELTRTFHPDMTITVEGNVITVTRPSDEKHHRALHGTTRSLLANMVEGVSKGYEKALELVGVGYRASKQGKKLVLSVGYSHPVEIEPEEGLEIEVPSQTKIIVKGADKQRVGELAANIRAVRPPEPYKGKGIRYEGELVRLKEGKTGK

SEQ ID NO: 1077 - protein, 178 aa, Bacillus subtilis
SRVGKKLLEIPSDVTVTLNDNNTVAVKGPKGELTRTFHPDMEIKVEDNVLTVARPSDQKEHRALHGTTRSLLGNMVEGVSKGFERGLELVGVGYRASKSGNKLVLNVGYSHPVEIVPEEGIEIEVPSQTKVVVKGTDKERVGAIAANIRAVRSPEPYKGKGIRYEGEVVRRKEGKSAK

SEQ ID NO: 1078 - protein, 183 aa, Chlamydia trachomatis
MSRKARDPIVLPQGVEVSIQNDEISVKGPKGSLTQVLAKEVEIAVKGNEVFVAPAAHVVDRPGRMQGLYWALIANMVKGVHTGFEKRLEMIGVGFRAAVQGSLLDLSIGVSHPTKMPIPTGLEVSVEKNTLISIKGINKQLVGEFAACVRAKRPPEPYKGKGIRYENEYVRRKAGKAAKTGKK

SEQ ID NO: 1079 - protein, 176 aa, Escherichia coli
SRVAKAPVVVPAGVDVKINGQVITIKGKNGELTRTLNDAVEVKHADNTLTFGPRDGYADGWAQAGTARALLNSMVIGVTEGFTKKLQLVGVGYRAAVKGNVINLSLGFSHPVDHQLPAGITAECPTQTEIVLKGADKQVIGQVAADLRAYRRPEPYKGKGVRYADEVVRTKEAKKK

SEQ ID NO: 1080 - protein, 176 aa, Haemophilus influenzae
SRVAKAPVNIPAGVEVKLDGQLLTVKGKNGELSRKIHESVEVKQDNGQFTFTPREGFVEANAQSGTARALVNAMVIGVTEGFTKKLVLVGVGYRAQLKGNAIALSLGYSHPVEHTLPVGITAECPSQTEIVLKGADKQLIGQVAADIRAYRRPEPYKGKGVRYADEVVRIKEAKKK

SEQ ID NO: 1081 - protein, 178 aa, Helicobacter pylori
MSRIGKRIIEIPSSVQASVEGSKLLFKNSKEKHELETHNRVKITLENNQLSFQPVGEDAQSRAYWGTYGALANNIVIGLSTGFSKTLEVNGVGYKVALGNKTLDLSLGFSHPVKYPIPAGIEMVVEKNTITIKGSDKQKVGQVAAEIRSFRPPEPYKGKGVKYSDEVIIRKAGKTAKK

SEQ ID NO: 1082 - protein, 177 aa, Methanobacterium thermoautotrophicum
MVLAALIREEIPIPDGVDVTIDGGVTVKGPKWELSRKFNHSEISMAVEDDKVVLEVKFPKKKDKAMIGTVRAHISNMITGVTEGFRYRMKIVYAHFPMSVKVAGDKVVIENFLGERHPRTARFVGDTKVQVKGDEVEITGINKEHVGQTMANIEQATKIKGRDPRVFQDGIYLVSKE

SEQ ID NO: 1083 - protein, 177 aa, Micrococcus luteus
SRIGRLPITIPAGVDVTIDGDRVSVKGPKGPKGQLEHSLPTPITATLEEGQVTVARPDDERESRSLHGLTRTLISNMVEGVTNGFSKQLEVVGTGYRVQAKGQDLEFDLGYSHPVPVKVSQGITFTVEGNRVTVAGIDKQQQVGETAANIRKLRRPDPYKGKGVYAGEQIRRKAGKK

SEQ ID NO: 1084 - protein, 180 aa, Mycoplasma capricolum
MSRIGNRLLQIPNGVEVKIAENNLVTITGSKGTLSKQFSPLIKIEVEENKLITKRLNEQKHTKQLHGTTNSLLQGMLTGVSEGFKKELQITGVGYKAAVNGSKLNLSLGYSHPVEFEIPDGVVIQAVKPTELAITGIDKQLVGQVAANIRAYRKPEPYKGKGIKYKNETIIRKEGKAAGK

SEQ ID NO: 1085 - protein, 179 aa, Mycobacterium leprae
MSRIGKQPIPVPAGVDITIDGQNVLVKGPKGTLDLTVAEPIMLARNDEGAIVVTRPDNERRNRSLHGLSRTLVSNLVTGVTQGYTVSMEIFGVGYRAQLKGSNLEFALGYSHPVVIEAPEGITFAVQSPTKFTITGIDKQKVGQISANIRRLRRPDPYKGKGVRYEGEQIRRKVGKTGK

SEQ ID NO: 1086 - protein, 179 aa, Streptomyces coelicolor
MSRIGKLPHRVPAGVDVTIDGRTVSVKGPKGSLTHTVVAPIDIAKGEDGVLNVTRPNDERQSKALHGLSRTLVANMITGVTQGYVKKLEISGVGYRVLAKGSNLEFSLGYSHPILVEAPEGITFKVENPTHFSVEGIDKQKVGEVAANIRNVRKPDPYKAKGVKYEGEVIRRKVGKAGK

SEQ ID NO: 1087 - protein, 179 aa, Synechococcus sp. (strain PCC 6301)
MSRIGKRPIPIPAKVSVAIDGRLVSVKGPKGELSRELPSGVVVTQEDGNIIVSRADESRLARQRHGLSRTLVANLVEGVDSGFQKRLEIIGVGYRAQVQGTTLILNVGYSNPVQIEPPEGIQFVVENNTNVVVSGISKEVVGNTAARIRAVRPPEPYKGKGIRYAGEVVLRKAGKTGKK

SEQ ID NO: 1088 - protein, 179 aa, Synechocystis sp. (strain PCC 6803)
MSRIGKRPIPLPAKVSVDIQGSHLSVKGPKGSLERQLPEKVIVAQEGETITVTRQDESRTARERHGLVRTLVANMVDGVAQGFERRLEIQGVGYRAQAQGNKLTLNVGYSKPVEMTMPQGIEVKVENNTQVIVSGIDKELLGNTAAKIRAVRPPEPYKGKGIRYQGEYVRRKAGKTGKK

SEQ ID NO: 1089 - protein, 179 aa, Thermus aquaticus (subsp. thermophilus)
SRIGRLPIPVPKGVSVEVAPGRVKVKGPKGELEVPVSPEMRVVVEEGVVRVERPSDERRHKSLHGLTRTLIANAVKGVSEGYSKELLIKGIGYRARLVGRALELTVGFSHPVVVEPPEGITFEVPEPTRVRVSGIDKQKVGQVAANIRAIRKPSAYHEKGIYYAGEPVRLKPGKAGAKK

SEQ ID NO: 1090 - protein, 126 aa, Saccharomyces cerevisiae
AKQSLDVSSDRRKARKAYFTAPSSQRRVLLSAPLSKELRAQYGIKALPIRRDDEVLVVRGSKKGQEGKISSVYRLKFAVQVDKVTKEKVNGASVPINLHPSKLVITKLHLDKDRKALIQRKGGKLE

SEQ ID NO: 1091 - protein, 126 aa, Saccharomyces cerevisiae
AKQSLDVSSDRRKARKAYFTAPSSERRVLLSAPLSKELRAQYGIKALPIRRDDEVLVVRGSKKGQEGKISSVYRLKFAVQVDKVTKEKVNGASVPINLHPSKLVITKLHLDKDRKALIQRKGGKLE

SEQ ID NO: 1092 - protein, 149 aa, Bacillus stearothermophilus
MKVIFLKDVKGKGKKGEIKNVADGYANNFLFKQGLAIEATPANLKALEAQKQKEQRQAAEELANAKKLKEQLEKLTVTIPAKAGEGGRLFGSITSKQIAESLQAQHGLKLDKRKIELADAIRALGYTNVPVKLHPEVTATLKVHVTEQK

SEQ ID NO: 1093 - protein, 149 aa, Bacillus subtilis
MKVIFLQDVKGKGKKGEVKNVADGYAHNFLIKKGLAVEANASNISALNGQKQKEKKEAIAELEQAKSLKETLEKLTVELSAKSGEGGRLFGSVTSKQITEQLQKDHNIKVDKRKLELPDGIRALGYTNVPVKLHPEVQAVLKVHVKEEA

SEQ ID NO: 1094 - protein, 150 aa, Helicobacter pylori
MMKVLLLEDVKNLGKAGEVCEVKDGYGNNFLIANQKAKLATNEVINKYKAEVKKKAEKEALEKAQKLQMVETLQTITLTIHKKVGANGSLFGAITKEEITERLKEQHASLNLDKKDIELKHPIKSTGIYEIEVKLGSGVVGVFKIDVVAE

SEQ ID NO: 1095 - protein, 150 aa, Mycoplasma genitalium
MKIILKQDVAKLGKRFDVVEVKDGFAIHFLFPKKLAAPLTKKAIANRDLFLKQQQEQYQKNRALAEKLKLVIEQTPLTFQLKQHDGKPYGSIITKQIINLAKQQRLDLQRFMFKDNVRLQFGEHKLILHLFEEITATLTVIVNPENGTTN

SEQ ID NO: 1096 - protein, 152 aa, Mycobacterium leprae
MKLILTADVDHLGSVGDTVEVKDGYGRNFLLPHGLAIVASRGAQRQADEIRRARETKAMRDREHANEIKVAIEALGSVSLPMKTVADSGKLFGSVTAGDVVAAIKKAGGPNLDKRIVRLPKTHIKAVGTHPVSVHLHPEVDVVVLLDVVAAR

SEQ ID NO: 1097 - protein, 149 aa, Mycoplasma pneumoniae
MKVILKQDVSNLGKRFDVVDVKDGYAIHFLFPKKLAAPLTKKSLQDRDLFLKKQQEHYEINKALSHKLKEVIEQTELHFSLKEHNGRPYGSIITKQIINQAHTKGMALQKFMFKDNVRLGFGDHEITLHIFEDTTAVLKVKVTPDNGVK

SEQ ID NO: 1098 - protein, 152 aa, Mycobacterium tuberculosis
MKLILTADVDHLGSIGDTVEVKDGYGRNFLLPRGLAIVASRGAQKQADEIRRARETKSVRDLEHANEIKAAIEALGPIALPVKTSADSGKLFGSVTAADVVAAIKKAGGPNLDKRIVRLPKTHIKAVGTHFVSVHLHPEIDVEVSLDVVAQS

SEQ ID NO: 1099 - protein, 150 aa, Neisseria gonorrhoeae
MQIILLEKIGGLGNLGDIVTVKNGYARNFLIPAGKAKRATEANMKEFEARRAELEAKQAEILADARARQEKLDGQTVTVAQKAGVDGRHNGSVTNADIAAAIVAAGIEAVKANVRLPNGPLKAVGEYEVEVALHTDAVAKITVAVIAAAE

SEQ ID NO: 1100 - protein, 152 aa, Synechococcus elongatus naegeli
MAKRVQVVLNETVNKLGRMGQVVEVAPGYARNYLFPRGIAEPATPSALRRVERLQEKERQRLAALKSIAEKQKATLEKLATITISMPVGEKDMLFGSVTPQDVADAIQAITGETIDRREMILPEIRKLGTYTAEIKLHPEVTVKLNIQVVAD

SEQ ID NO: 1101 - protein, 172 aa, Synechocystis sp. (strain PCC 6803)
MEVCELLHKLNKLHIGKITVMAKRVKVVLNETINKLGFTGDLVEVAPGYARNYLIPKGLGVVATPGILRQVEQRRLKELERLKAEKDAAEARKVALETIGRFVIKKQVGEAEAIFGTVTTQEVADAVEAATNQSLDRRGISLPDIHKTGFYQAQIKLHPEVIATVEVQVAPL

SEQ ID NO: 1102 - protein, 76 aa, Methanococcus jannaschii
MAKIFRITGIMSKKGKDPLYFRKEYKALKPEDALEILYSEFGGRYKVKRSRIKILNIEEIKPEDVTDPVLKKLVTA

SEQ ID NO: 1103 - protein, 78 aa, Methanobacterium thermoautotrophicum
MKMKTKIFRVKGKFLMGDKLQPFTKELNAIREEEIYERLYSEFGSKHRVPRSKVKIEEIEEISPEEVQDPVVKALVQR

SEQ ID NO: 1104 - protein, 85 aa, Sulfolobus acidocaldarius
AEVKIFMVRGTAIFSASRFPTSQKFTKYVRALNEKQAIEYIYSQLGGKNKIKRYNIHIQEIKEVKEDEITDKTIRDLAKLDKIIM

SEQ ID NO: 1105 - protein, 70 aa, Sulfolobus solfataricus
AEVKIFMVRGTAIFSASRFPTSQKYVRALNEKQAIEYIYSQLGGKNKINDTTYTYKRSKKLRKMKSQTRQ

SEQ ID NO: 1106 - protein, 101 aa, Marchantia polymorpha
MEAKFFCFLEIIGVGYKASTNAQGSILYLKLGFSHEIRLQVTPSVRVFCLKPNLICCTGMDHQKVTQFAAIVKSCKPPEVYKGKGIQYRNEIIHKKQGKKK

SEQ ID NO: 1107 - protein, 129 aa, Acanthamoeba castellanii
MINVQTVLKVADNSGAVFVSCIRLLNSSSRVGAGVGDTITVVVKKSIIKKNIKKSKEVKKGQVCSAVILRTIKGVKRWGNFFLRSSSNSVALINKYCLPIGSRLLGPVFREIRVNLKFSKIISIAQVTL

SEQ ID NO: 1108 - protein, 119 aa, Paramecium tetraurelia
MIQKETQLNVCDTSSVWVVNTFHIYRGFRHRIGRLGDYIKVSIRSTKPECTIKRGKKKKAIIVRHAFGRLKRDGSFSKFSSNVCVLLKKRTAPLGREIKGPIFYGVKKKKFVASFPGRV

SEQ ID NO: 1109 - protein, 119 aa, Tetrahymena pyriformis
MIQKETNLKPIDKCGVWSVRAFHLYGGSFRNQSTISNFLKVSVKKTRANNWVPKKTKLKAIIVTLKKELKKIDGSYIKFRTNNVVLLKKRLTPKGKILMGPVSSNLRRKRFLTSFCGSI

SEQ ID NO: 1110 - protein, 141 aa, Acanthamoeba castellanii
MRFKKYFKIKYKNNNVYEHDLIHFGDFGLKSLGNCNLTSEQLTASLKAIKRVIKKKNFLIIKALPFWMLTRKPRDVRMGRGKGSPAVKVYPLKAGKIIFEFKNVNETLLLRALKSSSLRLPVPTKVVKKYDKRTDCIKSSW

SEQ ID NO: 1111 - protein, 177 aa, Brassica napus
MYLTRKSIMLLRKYLLVTESQVSKCGFHIVKKKGDVLYPKRTKYSKGRCSRGCKPDGTKLGFGRYGTKSCRAGRLSYRAIEAARRATIGHSFRRAMSGQFRRNCKIWVRVLADLPITGKPAEVRMGRGKGNPTGWIARVSTGQIPFEMDGVSLANARQAARLAAHKPCSSTKFVQWS

SEQ ID NO: 1112 - protein, 138 aa, Chondrus crispus
MVIIKKTHNSFSLKHRHCNHTLKFGRLGLKILSFSKITENQFNLIERLSLKFLKNLSGNKKLIKIWSLVPFNLTLTKLSSEARMGKGKGAVYSRAFFLRPGSILFEFEGVSKHQLTQISSILRKKTSFRIVEVQLPSK

SEQ ID NO: 1113 - protein, 135 aa, Marchantia polymorpha
MLYPKRTKFRKYQKGRCKGCKADGTQLCFGKYGIKSCEAGRISYQAIEAARRAISRKFRRNSKIWVRVFADIPITSKPAEVRMGKGKGNTKGWIARVLKGQILFEMDCVSLSNAQQAATLAAHKLGLSIKFFKWS

SEQ ID NO: 1114 - protein, 155 aa, Petunia hybrida
MLLRKYLLVTESQVSKCGFLIVKKKRDVLYPKRTKYSKYRKGRCSRGCKPDGTQLGFGRYGTKSCRAGRLSYRAIEAARRAIIGHFHRAMSGQFRRNGKIWVRVLADIPITGKPTEVRMGRGKGNPTGWIARVSRGQILFEMDGVSLSNARQALH

SEQ ID NO: 1115 - protein, 135 aa, Prototheca wickerhamii
MLQPNNTKFRKFQKSRVKGVQSNTDQLRYGKFGIKTVSAARIPARTIEAVRRVITRKFKRLGVIWIRVFPDIAVSGKPAEVRMGKGKGAPQYWVCKVKRGAILFEFDGISPQLAKQAARLADSKLPIKTRFVMYS

SEQ ID NO: 1116 - protein, 156 aa, Saccharomyces cerevisiae
SYKQYFDSLPLKLKSFFQRYPPSIKYSPVSTSTKAINANPFLPNKHPVTQRFHDPKYSLRRMSDVYKLALRYGVEEFLPPIENTKKLFFEEKYNKKTLMKGVLLPKGHKHELKLNEKLKKREEALKKVDELIASKKGSKYAKRVEKMKKNQSIGWF

SEQ ID NO: 1117 - protein, 146 aa, Saccharomyces cerevisiae
MKGSPISQFSKTSINALTRPWKKYRDGELFYGLSKVGNKRVPLTTKQGNKTMYKGTRASGIGRHTKFGGYVINWKKVRTYVTPDMVNFELKPYVNANVPPLKHEFKGFSGGPLDPRLQLLKIKEYIVNGRVQSEGATDTSCYKERG

SEQ ID NO: 1118 - protein, 131 aa, Saccharomyces cerevisiae
MFGPFKLTSPVAGGLLWKIPWRMSTHQKTRQRERLRNVDQVIKQLTLGLHVQRCQDKGLTYQEAMESKKKYKPRSKSLRLLNKPSVFPKENQMSSKDKYWTFDKKAVGYRKGIHKVPKWTKISIRKAPKFF

SEQ ID NO: 1119 - protein, 85 aa, Saccharomyces cerevisiae
VFYKVTLSRSLIGVPHTTKSIVKSLGLGKRGSIVYKKVNPAIAGSLAKVKELVKVEVTEHELTPSQQRELRKSNPGFIVEKRTID

SEQ ID NO: 1120 - protein, 105 aa, Saccharomyces cerevisiae
MLARSLGYRLISTSRILYNKPTVKSVVSSCPAGTSLNLNIWKSGKDAVALEDKEYPNWLWSVLDSDHVVEHAAEDPEGQALLKRRKNIRKANRQRIKQNNFLSQL

SEQ ID NO: 1121 - protein, 138 aa, Saccharomyces cerevisiae
MIFLKSVIKVIDNSGAQLAECIKVIRKGSPKSPAMVGDRIVCVIQKAKPLTQNITGTANTNRVKKGDICHAIVVRSKQRNMCRKDGSTVAFGDTACVLINKNTGEPLGTRIMANDGCVDRTLKDKGYNKICSLASRVI

SEQ ID NO: 1122 - protein, 69 aa, Saccharomyces cerevisiae
VKVKSKNSVIKLLSTAASGYSRYISIKKGAPLVTQVRYDPVVKRHVLFKEAKKRKVAERKPLDFLRTAK

SEQ ID NO: 1123 - protein, 98 aa, Saccharomyces cerevisiae
MITKYFSKVIVRFNPFGKEAKVARLVLAAIPPTQRNMGTQIQSEIISDYNKVKPLVKVTYKDKKEMEVDPSNMNFQELANHFDRHSKQLDLKHMLEMH

SEQ ID NO: 1124 - protein, 137 aa, Saccharomyces cerevisiae
MSKVAQQLKFLNKISATTRLPQILVDPKKYSGLRLTFQTKNHNGHMGARVFWHNYLPTLQFYNPRMKFDVIRIKNEDKQKSVPCKLEILSHEGSVVETIDMRNKMHEDIMKDLLDKIEHVPLPENEIIRVGPQESII

SEQ ID NO: 1125 - protein, 102 aa, Cryptomonas phi
MQKQKIRIRLKGYETNLLLDSCNKIIETATRTNSVTAGPIPLPTRRKIYCVLRSPHVNKDSREHFETRIHKRVIDIYEPNSTTIDSLMQLDLPAGIDIDIKI

SEQ ID NO: 1126 - protein, 105 aa, Cyanophora paradoxa
MASNQQLKIRIQLRSYDSSLLENSCEQIIEAAKRTDATAVGPIPLPTKKKIYCVLRSPHVDKDSREHFEIRVHRRIIDLYLPSSKTIDTLTRLDLPAGVDVEVKL

SEQ ID NO: 1127 - protein, 103 aa, Odontella sinensis
MEIKTNAKIRVRLESFNHELLTSACRKISDTIQNSDATKLSVVSLPTDKRIYCVLRSPHVDKDSREHFELRVHKRVIEIYYDPTVKCRIISKFRITVRSIISY

SEQ ID NO: 1128 - protein, 105 aa, Porphyra purpurea
MTVTQQPKIRIKLKAYNSSLLNTSCKKIVDTAERTNAIAVGPIPLPTKRRIYCVLRSPHVDKDSREHFEIRSHRRIIDIHQPSSQTIDALMKLNLPSGVDIEVKL

SEQ ID NO: 1129 - protein, 130 aa, Chlorella vulgaris
MAKKIEKSAKKKFREKVLLGVAHIQSTFNNTIVTITTNKGNVLAWSSAGACGFKGARKKTPLAAKQAAENAAQTCVSQGMREIRVNVKGAGAGREAALRGLRDAGLNITIIRDITPIPHNGCRPPKKRRI

SEQ ID NO: 1130 - protein, 130 aa, Cyanophora paradoxa
MARQIKRSGTTKQKKNIPVGVAHIQSTFNNTIISITSPTGEVIAWASAGSSGFKGARKGTPFAAQTAAENSARQAMEQGMRQIEVIISGPGSGREMAIKALQATGLEISLIRDITPVPHNGCRPPKRRRV

SEQ ID NO: 1131 - protein, 136 aa, Epifagus virginiana
MAKAIPITGSRRNVHVGSRKSSFRIQKGVIHVQTSFNNTIVAVTDIKGRVVSWSSAGTCGFKGTRRGTSFAAQIAATNAIRIVQGMQRAEVMIKGPGIGRDAVLRAIRGSGVLLTFVRDVTPMPHNGCRPPKKRRV

SEQ ID NO: 1132 - protein, 129 aa, Euglena gracilis
MIKQKKKIIKITKKKFPKGIVHIKTTYNNVLVSVSDPKGNVIAWSSSGACGFKSSKKATPLATKTTTAIAVKKAIEQGLQKVEINISGPGTGRETALKCVQSLGLRISCIRDVTPLPHNGCRPSKRRRI

SEQ ID NO: 1133 - protein, 143 aa, Zea mays
MTKAIPKIGSRKKVRIGLRRNARFSLRKSARRITKGIIHVQASFNNTIITVTDPQGRVVFWSSAGTCGFKSSRKASPYAGQRTAVDAIRTVGLQRAEVMVKGAGSGRDAALRAIAKSGVRLSCIRDVTPMPHNGCRPPKKRRL

SEQ ID NO: 1134 - protein, 130 aa, Marchantia polymorpha
MPKSVKKINLRKGKRRLPKGVIHIQASFNNTIVTVTDIRGQVVSWSSAGACGFKGTKKSTPFAAQTAAENAIRILIDQGMKQAEVMISGPGPGRDTALRAIRRSGIILSFVRDVTPMPHNGCRPPRKRRV

SEQ ID NO: 1135 - protein, 130 aa, Odontella sinensis
MAQKIRKSTFKKDKNSSINGVVHIQSTFNNTIVTITNITGDTISWASAGSSGFKGARKGTPFAAQTAAEKAALDALSKGMKSVEVLVKGQGSGRETAIRSIEGAGFEVTSIQDITPVPHNGCRPPKRRRV

SEQ ID NO: 1136 - protein, 143 aa, Oryza sativa
MTKAIPKIGSRRKVRIGLRRNARFSLRKSARRITKGVIHVQASFNNTIITVTDPQGRVVFWSSAGTCGFKSSRKASPYAGQRTAVDAIRTVGLQRAEVMVKGAGSGRDAALRAIAKSGVRLSCIRDVTPMPHNGCRPPKKRRL

SEQ ID NO: 1137 - protein, 138 aa, Pisum sativum
MAKSIPKIGSRKTGRIGSRKHPRKIPKGVIYIQASFNNTIVTVTDVRGRVISWSSAGSCGFKGTRRGTPFAAQTAAGNAIQTVVEQGMQRAEVRIKGPGLGRDAALRAIYRSGILLKVIRDVTPLPHNGCRAPKKRRV

SEQ ID NO: 1138 - protein, 130 aa, Pinus thunbergii
MSKTIKRIGSRRNEHRVLKGVIYVQASFNNTIVTATDVRGQVLSWSSAGACGFKGTRRGTPFAAQTAAENVIRALMDRGMERVEVMISGPGRGRDTALRTIRRSGILLSFVRDVTPMPHNGCRPPKKRRV

SEQ ID NO: 1139 - protein, 130 aa, Porphyra purpurea
MARQIKKSGARKNKHNAVNGITHIKSTFNNTIVTITNLKGETLSWSSSGASGFKGAKKGTPFAAQTAAEKAAKQAMDQGMRQTEVLVNGPGAGRETAIRALQAAGLEITLIKDITPVPHNGCRPPKKRRV

SEQ ID NO: 1140 - protein, 138 aa, Spinacia oleracea
MAKPIPKIGSRRNGRISSRKSARKIPKGVIHVQASFNNTIVTVTDVRGRVVSWASAGTCGFRGTKRGTPFAAQTAAGNAIRTVVEQGMQRAEVMIKGPSLGRDAALRAIRRSGILLSFVRNVTPMPHNGCRPPKKRRV

SEQ ID NO: 1141 - protein, 138 aa, Nicotiana tabacum
MAKAIPKISSRRNGRIGSRKGARRIPKGVIHVQASFNNTIVTVTDVRGRVVSWSSAGTSGFKGTRRGTPFAAQTAAANAIRTVVDQGMQRAEVMIKGPGLGRDAALRAIRRSGILLTFVRDVTPMPHNGCRPPKKRRV

SEQ ID NO: 1142 - protein, 125 aa, Astasia longa
MSTIQQLVRKRRKKIKKKKKLAALDSCPQKKCICLKVHTITPKKPNSALRKVTRVKIISISKMFTTAYIPGIGHNLQEHSMVLIRGGRVKDLPGVKYKVIRGCLDAAGVKNRKNGRSKYGVKRPK

SEQ ID NO: 1143 - protein, 133 aa, Chlamydomonas reinhardtii
MPTIQQLIRSARKKITKKTKSPALKSCPQRRGICLRVYTVTPKKPNSALRKVARVRLTTGFEVTAYIPGVGHNLQEHAVVLVRGGRVKDLPGVRYHIVRGSLDTAGVKNRVQSRSKYGVKMGSKTAAKTAGKK

SEQ ID NO: 1144 - protein, 123 aa, Chlorella vulgaris
MPTIQQLVRSARTRLSKKTKSPALKSCPQRRGVCTRVYTTTPKKPNSALRKVARVRLTSGFEVTAYIPGIGHNLQEHSVVLVRGGRVKDLPGVRYHIVRGTLDSAGVKDRSQSRSKYGVKRPK

SEQ ID NO: 1145 - protein, 123 aa, Cryptomonas phi
MPTIQQLIRSERQTIQKTKSPALKSCPQRRGVCTRVYTTTPKKPNSALRKVARVRLTSGFEVTAYIPGIGHNIQEHSVVLLRGGRVKDLPGVRYHIIRGTLDAAGVKNRKQSRSKYGAKKPKE

SEQ ID NO: 1146 - protein, 123 aa, Cuscuta europaea
MPTIKQLIRNTRQPIRKVTKSPALRSCPQRRGTCTRVYTITPKKPNSALRKVARVRLTSGFEITAYIPGIGHNLQEHSVVLVRGGRVKDLPGVRYHIVRGTLDAVGVKDRQQGRSKYGVKKPK

SEQ ID NO: 1147 - protein, 124 aa, Cyanophora paradoxa
MPTIQQLIRSKRTKIEKKTKSPALKACPQRRGVCTRVYTTTPKKPNSALRKVARVRLTSGFEVTAYIPGIGHNLQEHSVVLVRGGRVKDLPGVRYHIVRGALDAAGVKDRRQSRSKYGAKRPKA

SEQ ID NO: 1148 - protein, 124 aa, Epifagus virginiana
MPTIKQLIRKKRQPNLNVTKSPALRGCPQRRGTCTRVYTITPKKPNSALRKVARVRLTSGIEITAYIPGIGHNSQEHSSVLVRGGRVKDLPGVRYHIIRGTLDAVGVKDRQQGRSKYGVKIKNK

SEQ ID NO: 1149 - protein, 124 aa, Euglena gracilis
PTLEHLTRSPRKKIKRKTKSPALKGCPQKRAICMRVYTTTPKKPNSALRKVTRVRLSSGLEVTAYIPGIGHNLQEHSVVLIRGGRVKDLPGVKYHVIRGCLDAASVKNRKNARSKYGVKKPKPK

SEQ ID NO: 1150 - protein, 124 aa, Hordeum vulgare
MPTVKQLIRNARQPIRNARKTAALKGCPQRRGTCARVYTINPKKPNSALRKVARVRLTSGFEITAYIPGIGHNLQEHSVVLVRGGRVKDLPGVRYRIIRGTLDAVAVKNRQQGRSKYGVKKPKK

SEQ ID NO: 1151 - protein, 124 aa, Zea mays
MPTVKQLIRNARQPIRNARKSAALKGCPQRRGTCARVYTINPKKPNSALRKVARVRLTSGFEITAYIPGIGHNLQEHSVVLVRGGRVKDLPGVRYRIIRGTLDAVAVKNRQQGRSKYGAKKPKK

SEQ ID NO: 1152 - protein, 123 aa, Marchantia polymorpha
MPTIQQLIRNKRQPIENRTKSPALKGCPQRRGVCTRVYTTTPKKPNSALRKIARVRLTSGFEITAYIPGIGHNLQEHSVVLVRGGRVKDLPGVRYHIIRGTLDAVGVKDRQQGRSKYGVKKSK

SEQ ID NO: 1153 - protein, 126 aa, Odontella sinensis
MPTIQQLVRSRRIQIKKKTKSPALVNCPQRRGVCTRVYTTTPKKPNSAIRKVARVRLTSDLKVTAYIPGIGHNLQEHSVVLIRGGRVKDLPGVRYHIIRGALDSVGVKDRTQGRSKYGVKKPKSDK

SEQ ID NO: 1154 - protein, 124 aa, Oryza sativa
MPTVKQLIRNARQPIRNARKSAALKGCPQRRGTCARVYTINPKKPNSALRKVARVRLTSGFEITAYIPGIGHNLQEHSVVLVRGGRVKDLPGVRYRIIRGALDAVAVKNRQQGRSKYGVKKPKK

SEQ ID NO: 1155 - protein, 123 aa, Pinus thunbergii
MPTIQQLIRNARQPIENRKKSPALRGCPQRRGVCARVYTITPKKPNSALRKVARVRLTSGFEITAYIPGIDHNLQEHSVVLVRGGRVKDLPGVRYHIVRGTLDAAEVKDRQQGRSKYGVKKQK

SEQ ID NO: 1156 - protein, 124 aa, Porphyra purpurea
MPTIQQLVRSERRKINKKTKSPALKSCPQRRGVCTRVYTTTPKKPNSALRKVARVRLTSGFEVTAYIPGVGHNIQEHSVVLIRGGRIKDLPGVRYHVVRGTLDAAGVKDRRKSRSKYGTKKPKS

SEQ ID NO: 1157 - protein, 123 aa, Glycine max
MPTMKQLIRNTRQPIRNVTKSPALRGCPQRRGTCTRVYTITPKKPNSALRKVARVRLTSGFEITAYIPGIGHNLQEHSVVLVRGGRVKDLPGVRYHIVRGTLDAVGVKDRQQGRSQYGAKKPK

SEQ ID NO: 1158 - protein, 123 aa, Spirogyra maxima
MPTIQQLIRNKRQAAENKTKSPALQRSPQRRGVCTRVYTTTPKKPNSALRKVARVRLTSGFEVTAYIPGIGHNLQEHSVVLVRGGRVKDLPGVRYHIVRGTLDVVGVKDRRKGRSKYGVKRPK

SEQ ID NO: 1159 - protein, 123 aa, Nicotiana tabacum
MPTIKQLIRNTRQPIRNVTKSPALRGCPQRRGTCTRVYTITPKKPNSALRKVARVRLTSGFEITAYIPGIGHNLQEHSVVLVRGGRVKDLPGVRYHIVRGTLDAVGVKDRQQGRSKYGVKKPK

SEQ ID NO: 1160 - protein, 169 aa, Arabidopsis thaliana
MAQMVAMPVAHSLSLICNWAKSNPLSRNTLALPASNTPNKQSLSIRCARVGGVEIPANKRIEYSLQYIHGIGRTRARQILVDLQMENKITKDMAEEELIILRDEVSKYMIEGDLRRFNALAIKRLKEIQCYRGVRHIQGLPCRGQRTKNNCRTLKGKKIAIAGKKKVSK

SEQ ID NO: 1161 - protein, 126 aa, Cyanophora paradoxa
MARIAGVDLPRDKRVEIGLTYIYGIGLTRSKEILSKIELDPDTRVRDLPDNAIAQLREIIETDYQVEGDLRRFESMNIKRLADIGCYRGRRHRLNLPVRGQRTRTNARTRRGARQTVAGKKKAPSK

SEQ ID NO: 1162 - protein, 123 aa, Odontella sinensis
VVRLIGVDLPRNKRIAYALTYIHGIGITSARKIIELAEISPETRTDDLTTEQTIALRDQLESIDLNLEGDLRCFNGLNIKRLNEINCHRGKRHRNNLPVRGQRTRTNARSRRGSKKTVTGKKK

SEQ ID NO: 1163 - protein, 126 aa, Porphyra purpurea
MARIAGVDLPRNKRIEIALTYIYGIGLSRSKEILKKTNIDADIRCQNLNDQQIVSIREILESSYQIEGDLKRFESMSIKRLMEISTYRGRRHRLGLPLRGQRTRTNARTRRGGKKTVAGKKKAPRK

SEQ ID NO: 1164 - protein, 100 aa, Astasia longa
MSKKSIIEREKKRKSLVKKYKNLRNFIKKEIKNELNFFEKIFLNFKLQKFPRDSSPCRLHNRCYLTGRPRGYYRFFGLSRHIFRDMAHYGLLPGVTKSSW

SEQ ID NO: 1165 - protein, 100 aa, Chlorella vulgaris
MAKKSMIERDRKRARLITKYAAKRKNLLVEIKTATSLEDKFNLHRKLQQLPRNSAPVRSHNRCTITGRPRGYFRDFGLSRHVLREYALQGFLPGVVKASW

SEQ ID NO: 1166 - protein, 100 aa, Cyanophora paradoxa
MAKKSMIERDKKRENLMNKYLVKRQQLKTRLNETDSVEEKLLLNQELQKLPRNSAPSRVRIRCWLTGRPRGNYRDFGVSRHVLREMAHQGLLPGVTKSSW

SEQ ID NO: 1167 - protein, 100 aa, Epifagus virginiana
MARKSLIQREKGRLKLENKYHFIRRSSKNEISKVPSLSDKWEIYGKLESPPRNSAPTRLRRRCFYTGRPRANYRDFGLCGHILREMVNACLLPGATRSSW

SEQ ID NO: 1168 - protein, 100 aa, Euglena gracilis
MSKKSLIARQRKRIILVLIHSHNRYVYRTNGKDEKSFEKKLRIYSFLQKLPRNSLRCRLRNRCYVTGRSRGYFRTFGLSRHILRDMAHYGLLPGVTKASW

SEQ ID NO: 1169 - protein, 103 aa, Zea mays
MAKKSLIQREKKRQKLEQKYHLIRRSSKKKIRSKVSPLSLSEKTKMQEKLQSLPRNSAPTRLHRRCFLTGRPRANYRDFGLSGHILREMVYACLLPGATRSSW

SEQ ID NO: 1170 - protein, 100 aa, Marchantia polymorpha
MAKKSLIQREKKRQNLEKKYKILRNSLKKKITETSSLDEKWEFQKKLQSLPRNSAPTRLHRRCFLTGRPKANYRDFGLSRHLLREMAHACLLPGVTKSSW

SEQ ID NO: 1171 - protein, 100 aa, Odontella sinensis
MAKKSMIEREKKRIKLNNKYTPKRNTLLQAYRQTEDFQSRLDIHSKIQKLPRNSAKNRIRNRCWKTGRPRGFYRDFGVSRHVLREMAHSCLLPGVTKSSW

SEQ ID NO: 1172 - protein, 103 aa, Oryza sativa
MAKKSLIQRERKRQKLEQKYHLIRRSSKKKIRSKVYPLSLSEKTKMREKLQSLPRNSAPTRLHRRCFLTGRPRANYRDFGLSGHILREMVYACLLPGATRSSW

SEQ ID NO: 1173 - protein, 100 aa, Pisum sativum
MAKKSLIAREKKRKKLEEKFYLIRRYPTKEMSKGGSLSESWEIQGKLEALPRNSAPTRLHRRCFLTGRPRANVRDFGLSGHILREMVHICLLPGATRSSW

SEQ ID NO: 1174 - protein, 99 aa, Pinus thunbergii
MARKSLIQREKKRQALERKYHLIRQSLEEKSKVSSLDDKWEIHRKLQSSPRNSAPTRLHRRCSSTGRPRANYRDFGLSGHILREMAHACLLPGIKKSSW

SEQ ID NO: 1175 - protein, 100 aa, Porphyra purpurea
MAKKNMIQREIKREKLEKKYYLKRLAIKEQLKKTTSFAEKIELRQKLQEMPRNSAPVRSRNRCWLTGRSRGYYRDFGLSRHVFREMSHECLLPGVTKSSW

SEQ ID NO: 1176 - protein, 100 aa, Spinacia oleracea
MARKSLIQREKKRRNLEQKYHLIRRSSKQEIRKVTSLSDKWEIHGKLQSPPRNSAPARLHRRCFLTGRPRANIRDFGLSGHILREMVHTCLLPGATRSSW

SEQ ID NO: 1177 - protein, 100 aa, Nicotiana tabacum
MARKSLIQREKKRQKLEQKYHSIRRSSKKEISKVPSLSDKWEIYGKLQSPPRNSAPTRLHRRCFLTGRPRANYRDFGLSGHILREMVHACLLPGATRSSW

SEQ ID NO: 1178 - protein, 90 aa, Zea mays
MKKKGGRKIFGFMVKEEKEENRGSVEFQVFSFTNKIRRLASHLELHKKDFSSERGLRRLLGKRQRLLAYLAKKNRVRYKKLISQLDIREK

SEQ ID NO: 1179 - protein, 88 aa, Marchantia polymorpha
MSKNLFMDLSSISEKEKGSVEFQIFRLTNRVVKLTYHFKKHGKDYSSQRGLWKILGKRKRLLAYLFKTNFVSYENLIIQLGIRGLKKN

SEQ ID NO: 1180 - protein, 90 aa, Oryza sativa
MKKKGGRKIFGFMVKEEKEENWGSVEFQVFSFTNKIRRLASHLELHKKDFSSERGLRRLLGKRQRLLAYLAKKNRVRYKKLISQLDIRER

SEQ ID NO: 1181 - protein, 88 aa, Pinus thunbergii
MINNLSISSSLIPDKQRGSVESQVFYLTNRVLRLTQHLQLHGRDYSSQRGLWKILSKRKQLLVYLSKRDKLRYDDLIGQLGIRGLKTR

SEQ ID NO: 1182 - protein, 90 aa, Secale cereale
MKKKGGRKIFGFMVKEEKEENRGSVEFQVFSFTNKIRRLASHLELHKKDFSSERGLRRLLGKRRRLLAYLAKKNRVRYKKLIGQLNIREQ

SEQ ID NO: 1183 - protein, 87 aa, Nicotiana tabacum
MVKNSVISVISQEEKRGSVEFQVFNFTNKIRRLTSHLELHKKDYLSQRGLKKILGKRQRLLAYLSKKNRVRYKELINQLDIRETKTR

SEQ ID NO: 1184 - protein, 77 aa, Cyanidium caldarium
MLKIRLKRCGRKKQTSFKIVVMNNLDKRDGQAIEELGFMNPRTKEKYLNINKINHYLRLGAKPTKTVFDLLNKAKII

SEQ ID NO: 1185 - protein, 77 aa, Cyanophora paradoxa
MVKLRLKRYGRKGQVTYRIVAMNNLSRRDGKAIEELGFYNPRTNESSLNIANIKRRIEQGAQPTNTVRYILAKANIL

SEQ ID NO: 1186 - protein, 85 aa, Hordeum vulgare
MVKLRLKRCGRKQQAVYRIVAIDVRSRREGRDLRKVGFYDPIKNQTCLNVPAILYFLEKGAQPTRTVYDILRKAEFFKEKERTLS

SEQ ID NO: 1187 - protein, 85 aa, Zea mays
MVKLRLKRCGRKQQAIYRIVAIDVRSRREGRDLRKVGFYDPIKNQTCLNVPAILYFLEKGAQPTRTVYDILRKAEFFKDKERTLS

SEQ ID NO: 1188 - protein, 79 aa, Odontella sinensis
MLKLRLKRSGRKKQPSYRLVVMENTTRRDGRPVEQVGYYNTITKESYFDVIKIKKWLNYGAKPTQTVLNLLKKAKIIDQ

SEQ ID NO: 1189 - protein, 62 aa, Oryza sativa
MLKLRLKRCGRKQRFYDPIKNQTCLNVPAILYFLEKGAQPTRTVSDILRKAEFFKEKERTLS

SEQ ID NO: 1190 - protein, 82 aa, Porphyra purpurea
MVKLRLKRYGRKQQPSYRIVAMDSRSKRDGKAIEELGFYNPITNETRIDIAKILKRLKQGAQTTRTVKNILNEAQIIAKENS

SEQ ID NO: 1191 - protein, 88 aa, Sinapis alba
MVKLRLKRCGRKQRAVYRIVAIDVRSRREGRDLRKVGFYDPITNQTYLNLPAILDFLKKGAQPTRTVHDISKKAGIFTELNLNKTKLN

SEQ ID NO: 1192 - protein, 88 aa, Solanum tuberosum
MVKLRLKRCGRKQRAVYRIVAIDVRSRREGKDLQKVGFYDPIKNQTYLNVPAILYFLEKGAQPTETVQDILKKAEVFKELRLNQPKFN

SEQ ID NO: 1193 - protein, 85 aa, Nicotiana tabacum
MVKLRLKRCGRKQRAVYRIVAIDVRSRREGKDLRKVGFYDPIKNQTYLNVPAILYFLEKGAQPTGTVQDILKKAEVFKELRPNQS

SEQ ID NO: 1194 - protein, 149 aa, Arabidopsis thaliana
MITSSLTSSLQALKLSSPFAHGSTPLSSLSKPNSFPNHRMPALVPVIRAMKTMQGRVVCATSDKTVAVEVVRLAPHPKYKRRVRMKKKYQAHDPDNQFKVGDVVRLEKSRPISKTKSFVALPVIARAARKAEAGGDELLGLPLESQQPA

SEQ ID NO: 1195 - protein, 88 aa, Cyanophora paradoxa
MASKERVGVVIRNPQEKTVIVAVNNRVRHNKYSKIIIRTKKYQVHDHSHICKLGDEVKISEVKPISKTKRWIISEVLSSTVNPEKFGD

SEQ ID NO: 1196 - protein, 84 aa, Odontella sinensis
MPVKEKVGIVVSNKMQKTIVVKVESRYSHPIYSKTMTKTRKYLAHDEMGECNIGDQVLVQECRPLSKRKRWTLSKVLSKSSLVS

SEQ ID NO: 1197 - protein, 83 aa, Porphyra purpurea
MPLKETTGKVVSDKMNKTIVVAVENRISHRKYAKTMTRTKKYKAHDENNECAVGDIVTIQETRPLSRTKCWTMVNILSKSFHN

SEQ ID NO: 1198 - protein, 103 aa, Chlorella vulgaris
MAGIQQKRKTIKSFKTRRKVVPVLIPKKGQAVISNTGEPASRYIIDYKNTQLLVKFISPQGKILSRRATGLTAKQQRIMANAIKRARMGGLVPFVNYELGSKK

SEQ ID NO: 1199 - protein, 71 aa, Cyanophora paradoxa
MSVYRRRLSPLKPNQVIDYQDVELLRTFITDQGKILPRRVTGLTAKQQRAVTKAIKQARVLALLPFVNRES

SEQ ID NO: 1200 - protein, 92 aa, Epifagus virginiana
MYKFKRSFRRRLSPIGSGNLIYYRNMSLISRFISEQGKILSRRVNRLTLKQQRLITIAIKQARILSLLPFINNEKQFERIESITRVKGFIKK

SEQ ID NO: 1201 - protein, 64 aa, Euglena gracilis
MKYPALIDYKNVNILRRFINFQGKIIPKRLNKPKLTYKQHRLLRKSVKQARYLGLLPFKTKDFF

SEQ ID NO: 1202 - protein, 75 aa, Marchantia polymorpha
MNKSKRSSRRRMPPIRSGEIIDYKNISLLRRFVSEQGKILSRRMNRLTSKQQRLLTIAIKRARVLALLPFLNNEN

SEQ ID NO: 1203 - protein, 72 aa, Odontella sinensis
MLAQKQKLSPISVNQKIDYKDIDLLKLFITEQGKILPRRATGVTVQQQRQIAKAIKRARVLSLLPFVASNSI

SEQ ID NO: 1204 - protein, 163 aa, Oryza sativa
MYTSKQPFHKSKQTFHKSKQTFRKSKQTFRKFKQPFRKPKQPFRRRPRIGPGDRIDYRNMSLINRFISEQGKILSRRINRLTLKQQRLITLAIKQARILSFLPFRNYENEKQFQAQSISIITGPRPRKNRHIPPLTQKFNSNRNLRNSNQTLRNTNRNLSSDC

SEQ ID NO: 1205 - protein, 110 aa, Pisum sativum
MDKSKRLFVKSKQSIRRSSPLIQSGDRIDYKNLSLLFKFISRQGKILSRRVNKLTLKQQRLITIAIKQARILSLLPFVNSSSFVNNAKKKYEKRKSITRTRTPVLKKKKK

SEQ ID NO: 1206 - protein, 100 aa, Pinus thunbergii
MKQTMDKPKQSFRRHFKPIRRRFKPIRRYLKPIRRHLSPIRSGDRIDYKNMSLISRFISEQGKILSGRVNRLTSKQQRLMTNAIKRARILSLLPFLYNEN

SEQ ID NO: 1207 - protein, 70 aa, Porphyra purpurea
MAVYRKKISPIKPTEAVDYKDIDLLRKFITEQGKILPKRSTGLTSKQQKKLTKAIKQARILSLLPFLNKD

SEQ ID NO: 1208 - protein, 101 aa, Nicotiana tabacum
MDKSKRPFLKFKRSFRRRLPPIQSGDRIDYRNMSLISRFISEQGKILSRRVNRLTLKQQRLITLAIKQARILSLLPFLNNEKQFERTESTARTTGFKARNK

SEQ ID NO: 1209 - protein, 118 aa, Astasia longa
MSRSSKKSPFISYRLFNTIDKMNLKNLKQLVFTKSRSSTVFPSMVGHNISVYNGKNYVPFLILNQMISSKLGEFSRTRNFRGHKGINKKLIKKSSKKVTKNKKSIKKNIKTTSKKFKK

SEQ ID NO: 1210 - protein, 92 aa, Chlorella vulgaris
MARSLKKAPFVANHLLEKVERLNTQGDKKVIKTWSRSSTIVPLMIGHTIAVHNGREHIPVFITDQMVGHKLGEFAPTRTFRGHVKKDKKSKR

SEQ ID NO: 1211 - protein, 92 aa, Cyanophora paradoxa
MARSLKKGPFIAHHLLKKVELLNTSGKTEVIKTWSRASTILPMMVGHTIAVHNGRQHLPVFITDQMVGHKLGEFAPTRTFKGHTKSDKKARR

SEQ ID NO: 1212 - protein, 94 aa, Epifagus virginiana
MIHSPTLKKNLFVANHLRAKINKLNNKKKKEIIVTWSRASTIIPIMIGHMISIHNGKEHLPIYITDHMVGHKLGEFVPTLNFRGHAKSDNRSRR

SEQ ID NO: 1213 - protein, 94 aa, Euglena gracilis
MSRSLKKGPFVFYSLIKKVDQMNSNRFKSVILTWSRSCTIIPIMIGNTIGVYNGKEHIPVLVSDQMIGHKLGEFVQTRNYRGHKKHDKKTKTKR

SEQ ID NO: 1214 - protein, 92 aa, Zea mays
TRKKTNPFVARHLLAKIEKVNMKEEKEIIVTWSRASSILPAMVGHTIAIHNGKEHIPIYITNPMVGRKLGEFVPTRHFTSYESTRKDTKSRR

SEQ ID NO: 1215 - protein, 91 aa, Marchantia polymorpha
TRSIKKGPFVADHLLKKIENLNLKKEKKIIITWSRASTIVPTMIGHTIAVHNGQEHLPIYITDRMVGHKLGEFAPTRTFRGHAKNDKKSRR

SEQ ID NO: 1216 - protein, 92 aa, Odontella sinensis
MPRSLKKGPFVAYHLLKKIDKMNASGKKDVITTWSRTSTILPTMVGHTIAVYNGRQHVPIFISDQLVGHKLGEFVSTRTFKSHIKTDKKTKR

SEQ ID NO: 1217 - protein, 92 aa, Oryza sativa
TRKKTNPFVAHHLLAKIEKVNMKEEKETIVTWSRASSILPAMVGHTIAIHNGKEHIPIYITNPMVGRKLGEFVPTRHFTSYESARKDTKSRR

SEQ ID NO: 1218 - protein, 91 aa, Pisum sativum
TRSRKKNPFVANHLLKKIKKLNTKGEKAIIKTWSRKSTIIPIMIGHTIAIHNGKEHLPVYITDRMVGHKLGEFSPTLNFGGFAKNDNKSRR

SEQ ID NO: 1219 - protein, 92 aa, Pinus thunbergii
MARSLKKNPFVANHSLRKIKNLNIKEEKKIIVTWSRASVIVPAMIGHTIAVHNGREHLPIYVTDRMVDHKLGEFAPTLLFQGHARNDKKSRR

SEQ ID NO: 1220 - protein, 92 aa, Porphyra purpurea
MSRSIHKGPFIDVSLLTRIEALNTSGKKEVIKTWSRASTIIPDMIGHTIAVYNGKQHFPVFVSDQMVGHKLGEFVPTRTFRTHVKGDRKARR

SEQ ID NO: 1221 - protein, 92 aa, Secale cereale
TRKKTNPFVAHHLLAKIEKVNMKEEKETIVTWSRASSILPTMVGHTIAIHNGKEHIPIYITNPMVGRKLGEFVPTRHFTSYENARKDTKSRR

SEQ ID NO: 1222 - protein, 91 aa, Glycine max
TRSLKKNPFVANHLLRKINKLNTKAEKDIIITWSRASTIIPTMIGHTIAIHNGKEHLPIYITDRMVGHKLGEFSPTLNFRGHAKNDNRSRR

SEQ ID NO: 1223 - protein, 91 aa, Spinacia oleracea
TRSLKKNPFVANHLLRKIEKLNKKAEKEIIVTWSRASTIIPTMIGHTIAIHNGREHLPIYITDRMVGHKLGEFAPTLNFRGHAKNDNKSRR

SEQ ID NO: 1224 - protein, 91 aa, Nicotiana tabacum
TRSLKKNPFVANHLLKKIDKLNTKAEKEIIVTWSRASTIIPTMIGHTIAIHNGKEHLPIYITDSMVGHKLGEFAPTLNFRGHAKSDNRSRR

SEQ ID NO: 1225 - protein, 95 aa, Cyanophora paradoxa
MANTKSAIKRIKTIERNRIRNCAYKSVVKTFIKKYLKVLSDYTNAPNSNGVENIQTTLGIVYTKIDKAVKRGVYHSNKAARMKSKLALKYNVIKK

SEQ ID NO: 1226 - protein, 93 aa, Odontella sinensis
MANNASAEKRILINERNRLQNRFYKSSVRTLTKLYLKDLEVYKISRNPSDKEKAKNRLSLVYSLIDKGSKRNVFHKNTAARKKSKLASQLKIA

SEQ ID NO: 1227 - protein, 94 aa, Porphyra purpurea
MAKNLSAIKRIKTSERNRLINRKYKSVVKTLTKRCLMNIENLENSNLNDVQLSISQVYSKIDKAIKKGAFHPNTGARKKARLARIFAYAQKQQN

SEQ ID NO: 1228 - protein, 169 aa, Cyanophora paradoxa
MANRQKMSKTRDKKPDWQERVVQIRRVSKVVKGGKKLSFRAIVVIGNERGQVGVGIGKASDVINAVKKAAADGKKHVVEVPLTRSNSIPHPIDGIGGAARVIMRPSAEGTGVIAGGAVRTVLELAGVRNILAKQLGSNNPLNNARAAMNALSRLKTFSQFAKDRGVIAE

SEQ ID NO: 1229 - protein, 185 aa, Odontella sinensis
MSTDLKQVNKSKKALQRNDNLSESKFVERLIKISRVSKVTKGGKKLSFRAIVVVGNENGQVGVGVGKADDVVNAFKKAKADGRKNLIKIPITKSLSIPHNVIGIFGACKIIMRPSIEGSGVIAGGSVRTVLEVAGIKNVIAKQLGSNNVLNNARAAVSGLNNLTTKSQVLKKRDLHSNSSEKINS

SEQ ID NO: 1230 - protein, 174 aa, Porphyra purpurea
MANRKKQGKSKEKDNGWEERVVQVKRVTKVVKGGKKLSFRVILVVGNEQGQVGVGVGKASDVIGAVKKGVTDAKKHLVTVPLTKSNSIPHPINGISGAAQVILRPSAPGSGVIAGGSVRTVLELSGVQNILAKQLGSNNTLNNARAVLNGLTQLRTFSEAAKDRGVPIENLYSK

SEQ ID NO: 1231 - protein, 103 aa, Cyanidium caldarium
MKTITIPRQNLTQYEIMLIMRPDLPEEKFLKFLSEIKEHAKRNLALEFNLSNRGRRKLAYAMRKFQDGIYIQFNFLGSGYILNSLIKRLKLEESILRYIVQKT

SEQ ID NO: 1232 - protein, 104 aa, Cyanophora paradoxa
MQVITLQKPSKKITYRTTYILKPSLTEEEITKEIEDYQKLLIDNGAEDIIIENTGKCRLAYLINKQNDGIYFQITYRGANTLVNILQRRMRLSINTLRYQTFKV

SEQ ID NO: 1233 - protein, 96 aa, Odontella sinensis
MSATKKYEMMILLTEEFNDSELKTWAFNYAKALRKLSASEISVISRGKRDLSYYINNQKKGNFIQINFSSMPKYVDNFSKNLKFDSNVLRFLILNK

SEQ ID NO: 1234 - protein, 112 aa, Porphyra purpurea
MLQTKNSQEIKLNWYETVYLIKSDLNEDRTLCIINEYKSMLTNGGAKNIILQHRGRRHLSYSIKDYRDGIYVQVNYEGNGKLVQSFEKSLRFDENIIRYLTNKQNKDNKIEG

SEQ ID NO: 1235 - protein, 156 aa, Chlorella vulgaris
MSRRRTQKKRIVMPDPVYDSRLVELLVRQLMREGKKSLAYRICYESMNRVADATQQDPLVIVEQAIRNATPLVEVKARRIGGSTYQVPLEVASERGTALAIRWILSVCRKKTGRPMAAKLTAELLDAAKNSGLAVRKRDEIHKMADANKAFAKYRF

SEQ ID NO: 1236 - protein, 156 aa, Cryptomonas phi
MSRRSTTKKKLALPDPIYNSRLVNMLTVRILKEGKKHLAQRIIYNAFDIIKQRTGEDAILVFESAIKKVTPLVEVKARRIGGSTYQVPMEVRAFRGTNLALRWITKYARERAGKSMSMKLANEIMDAANETGSSIRKREEIHRMAEANKAFAHYRF

SEQ ID NO: 1237 - protein, 155 aa, Cuscuta europaea
MSRRGTAEKKKAKSDPIYRNRLVNMLVNRILKHGKKSLAYQIMYRAVKTIQQNTEKNPLSVLRQAIRGVTPDLTVKARRVSGSTHQVPIEIRSTQGKALAVRWLLAASRKRPGRDMAFKLSSELVDAAKGRGDAIRKKEETHRMAEANRAFAHFR

SEQ ID NO: 1238 - protein, 155 aa, Cuscuta reflexa
MSRRGTAEKKTAKSDPIYRNRLVNMLVNRILKHGKKSLAYQIIYRAVKKIQQKTETNPLSVLRQAIRGVTPDITVKARRVGGSTHQVPVEIGSTQGKALAVRWLLAASRKRPGRDMAFKLSSELVDAAKGSGDAIRKKEETHRMAEANRAFAHFR

SEQ ID NO: 1239 - protein, 156 aa, Cyanophora paradoxa
MSRRSTAKKRLILPDPIYNSRLVTLLINHMLKDGKKSIARSFIYEALKIIEEKKGSDPLEVLEQAVRNSTPLIEVKARRIGGSTYQVPMEVRVDRGITLALRVVNSFSLQRLGKTIAVKLANELIDAANETGNTIKKREEMHRMAEANKAFVHYRY

SEQ ID NO: 1240 - protein, 155 aa, Epifagus virginiana
MSRRGTAEEKTAKPDPIYWNRLVNMLVNRILKHGKKSLAYQIIYRALKKIQQKTEKNPLYVLRQAIRGVTPDIAVKARRVGGSTHQVPIEIGSTQGKALAVRWLLVASKKRPGQNMAFKLSSELVDAAKGSGDAIRKKEETHKMAEASRAFAHLR

SEQ ID NO: 1241 - protein, 155 aa, Euglena gracilis
SRRRRAKKRIISQDPIYNSTLASKVINKILLNGKKTLAQYIFYETMKNIQEIYKKDPLDILRKAIKNASPQMETRKRRIGGTIYQVPVEVKEDRGTSLALKFIIEKARERKGRGISTKLKNEIIDASNNTGEAVKKKEEIHKTAEANKAFSNMKF

SEQ ID NO: 1242 - protein, 156 aa, Zea mays
MSRRGTAEKRTAKSDPIFRNRLVNMVVNRIMKDGKKSLAYQILYRAVKKIQQKTETNPLLVLRQAIRRVTPNIGVKTRRNKKGSTRKVPIEIGSKQGRALAIRWLLEASQKRPGRNMAFKLSSELVDAAKGSGGAIRKKEATHRMAEANRALAHFR

SEQ ID NO: 1243 - protein, 155 aa, Marchantia polymorpha
MSRKSIAEKQVAKPDPIYRNRLVNMLVNRILKNGKKSLAYRILYKAMKNIKQKTKKNPLFVLRQAVRKVTPNVTVKARRIDGSTYQVPLEIKSTQGKALAIRWLLGASRKRSGQNMAFKLSYELIDAARDNGIAIRKKEETHKMAEANRAFAHFR

SEQ ID NO: 1244 - protein, 158 aa, Odontella sinensis
MSRRNISKKRFPEADSTYNSYLVSLLITRILKSGKKNLAQNIVNAAFEIIKVKTNEDPLVVFERAIRNASPVVEVKARRIGGSTYQVPVEVSGFRATNLSLRWIIQYSRQRVGRTMSIKLANEIIDTANDIGNTIKKKEETHKMQMPIKHLHIFVINY

SEQ ID NO: 1245 - protein, 156 aa, Oryza sativa
MSRRGTAEKRTAKSDPIFRNRLVNMVVNRIMKDGKKSLAYQILYRAVKKIQQKTETNPLLVLRQAIRRVTPNIGVKTRRNKKGSTRKVPIEIGSKQGRALAIRWLLEASQKRPGRNMAFKLSSELVDAAKGGGGAIRKKEATHRMAEANRALAHFR

SEQ ID NO: 1246 - protein, 155 aa, Pinus thunbergii
MSRRSTAEKKTAKSDPIYHNRLVNMVVNRILKNGKKSLAYRILYRAIKKIQQKTDKNPLSVLRQAIRRVTPNVTVKARRVGGSTYRVPTEIRSTQGKVLAIRWLLGASRKRPGRNMNFKLSHELMDAARGNGNAIRKKEETHRMAEANRAFAHFR

SEQ ID NO: 1247 - protein, 156 aa, Porphyra purpurea
MSRRNTAKKRFASPDPLYKSRLVSMLTVRILKSGKKTLAQRIIYQALDIVKERTETDPLNVLEKAIRNITPLVEVKARRVGGSTYQVPIEVRAYRGTNLALRWITRFSRERSGKSMSMKLANEIMDAANETGNSIRKREETHRMAEANKAFAHYRY

SEQ ID NO: 1248 - protein, 155 aa, Glycine max
MSRRGTAEEKTAKSDPIYRNRLVNMLVNRILKHGKKSLAYQIIYRAMKKIQQKTETNPLSVLRQAIRGVTPDIAVKARRVGGSTHQVPVEIGSTQGKALAIRWLLGASRKRPGRNMAFKLSSELVDAAKGSGDAIRKKEETHRMAEANRAFAHFR

SEQ ID NO: 1249 - protein, 155 aa, Spirogyra maxima
MSRRSNTVSRPTKPDPIYRNRLVNMLVNRILKNGKKSLGYRILYTALKTIKQKTKKNPLSVLRQAVRRATPNVVVKARRRGGSTYQVPIEVKPSQGRALAIRWLLSAARKRSGRSMGLKLSYELMDAARQTGNAIRKREETHRMAEANRAFAHFR

SEQ ID NO: 1250 - protein, 155 aa, Nicotiana tabacum
MSRRGTAEKKTAKSDPIYRNRLVNMLVNRILKHGKKSLAYQIIYRAVKKIQQKTETNPLSVLRQAIRGVTPDITVKARRVGGSTHQVPIEIGSTQGKALAIRWLLAASRKRPGRNMAFKLSSELVDAAKGSGDAIRKKEETHRMAEANRAFAHFR

SEQ ID NO: 1251 - protein, 142 aa, Astasia longa
MTTIDTISDVITRIRNANILKLDRVELINTKVAIGICHILKDRGFINSFGEFLNSSDRMSNRRFIQKYIIVNLKYKGERRSPCIKELRRISKPGRRVYVGYKNLHKTKGGIELFVLSTSKGLITDYTAREKGIGGELLFSIC

SEQ ID NO: 1252 - protein, 138 aa, Chlorella vulgaris
MVNDTISDMLTRIRNANLAKKTSVSLPKTKVHEKMCQILEQEGFIKTFSFSETNTNELIVDLKYQDFASFGNYGVGKPCITNLKRISKPGLRIYTNSREIPKVLGGMGILILSTSKGLMTDRQARKLCLGGEILCSVW

SEQ ID NO: 1253 - protein, 132 aa, Cyanophora paradoxa
MVNDTIADMLTGIRNANLAKHKVARVKATKITRCLANVLKEEGLIQNFEEIENNLQNELLISLKYKGKKRQPIITALKRISKPGLRGYANHKELPRVLGGLGIAILSTSSGIMTDQTARHKGCGGEVLCYIW

SEQ ID NO: 1254 - protein, 134 aa, Epifagus virginiana
MGRDTILEIINSIRNADRGRKRVVRITSTNITENFVKILFIEGFIENARKHREKNKYYFTLTLRHRRNSKRPYINILNLKRISRPGLRIYSNSQQIPLILGGIGIVILYTSRGIMTDREARLKGIGGELLCYIW

SEQ ID NO: 1255 - protein, 140 aa, Euglena gracilis
MTNIDVISDMLTRIRNSLLIKARKVNVINTKLTVNIAEILKKEGFIDSFELADATCLTENGVIKKYITIFLKYKGPKQVSYITKIKRVSKPGLRTYSSYKRLQSVAGGVGLTVLSTSKGLMTDRLARSNKIGGEILFYIW

SEQ ID NO: 1256 - protein, 136 aa, Zea mays
MGKDTIADLLTSIRNADMNKKGTVRVVSTNITENIVKILLREGFIESVRKHQESNRYFLVSTLRHQRRKTRKGIYRTRTFLKRISRPGLRIYANYQGIPKVLGGMGIAILSTSRGIMTDREARLNRIGGEVLCYIW

SEQ ID NO: 1257 - protein, 132 aa, Marchantia polymorpha
MGNDTIANMITSIRNANLGKIKTVQVPATNITRNIAKILFQEGFIDNFIDNKQNTKDILILNLKYQGKKKKSYITTLRRISKPGLRIYSNHKEIPKVLGGMGIVILSTSRGIMTDREARQKKIGGELLCYVW

SEQ ID NO: 1258 - protein, 132 aa, Odontella sinensis
MVTDTISDMLTRIRNANMIKHQIVQIPATKMSKAITNILKEEGFIEDYEIYMENSYQFLLISLKYKGKSREPVICKMVRVSKPGLRVYSKSKKLPKVLDNLGIAIISTSKGVMTNLKAKELGIGGEVLCYIW

SEQ ID NO: 1259 - protein, 136 aa, Oryza sativa
MGKDTIADLLTSIRNADMNKKGTVRVVSTNITENIVKILLREGFIESVRKHQESNRYFLVSTLRHQKRKTRKGIYRTRTFLKRISRPGLRIYANYQGIPKVLGGMGIAILSTSRGIMTDREARLNRIGGEVLCYIW

SEQ ID NO: 1260 - protein, 132 aa, Pinus thunbergii
MGNDTITNLITSIRNADMVEKGTVRVTATNITKNIGRILLREGFIEDVREHQEGQKYFLISTSKYRRRKKRTYMTTSKRTSKPGLRIYSNYREIPKVLGGMGIVILSTSQGILTDREARQKKIGGEILCYVW

SEQ ID NO: 1261 - protein, 133 aa, Porphyra purpurea
MVVNDTVADMLTRIRNANLARHQIVQVPATKVTRNMALVLKEEGFVHNFEQMGEGIETHLMISLKYNGKNRQPVITALKRISKPGLRVYANHKELPRVLGGLGIAIISTSQGVMTDRQARHDGLGGEILCYIW

SEQ ID NO: 1262 - protein, 134 aa, Nicotiana tabacum
MGRDTIAEIITSIRNADMDRKRVVRIASTNITENIVQILLREGFIENVRKHREKNKYFLVLTLRHRRNRKRPYRNILNLKRISRPGLRIYSNYQRIPRILGGMGIVILSTSRGIMTDREARLEGIGGEILCYIW

SEQ ID NO: 1263 - protein, 137 aa, Chlorella vulgaris
MIKITKTISQSTQSGGRKTAKARVQLLPGTGTKVMVNGKQASDYFQNNAVYLQNMFTPRDLVKTETKYDVHILVEGGGLSAQAQAVKLALSKAFVDFFPEYRKVFKKPGLLTRDARIKERRKYGLKKARKAPQFSKR

SEQ ID NO: 1264 - protein, 134 aa, Cyanophora paradoxa
MGQKEQTLAYGTGRRKTSVAKVRLIPGKGEILINSKPANLYLQYNLSYLAAVKSPLESLGLANEYNVIVNTQGGGLTGQSEAIRLGLARALCQISLTHRPLLKSDHHLTRDARAKERKKYGLHKARKAPQYSKR

SEQ ID NO: 1265 - protein, 134 aa, Euglena gracilis
MKLNSIEVIGKRKSSIAKIILFLPKDGGGEILINGEKAFNYLQNNLRTLKVVCSPFELLNINNYKVHAYVKGGGLSGQADAIKLAISKSLSVFIEKEDKKKLKVNGFLTRNSLCKERRKYGLKKARKAPQFSKR

SEQ ID NO: 1266 - protein, 138 aa, Odontella sinensis
MNTKIGLSLSEKYYWSWKTKTSNCPCFSCSGEGNIVINKVSGEKYLQYNLTYLKDIWAPLKELNLEKQFDIIALVRGGGLTGQTESIQLGVARLLCQMNPQNRSVLKPFGFLTRDARIKERKKYGLRKARKAPQYSKR

SEQ ID NO: 1267 - protein, 137 aa, Porphyra purpurea
MSTELIKTRAIYSGTGRRKCSVAQVRLVPGSGNLVINGIPGESYLQFSPNYLRVSYAPLQVLGLLNQYDIHVNARGGGLTGQADAIRLGVARALCSINPENRSALKSEGYLTRDPKVKERKKYGLKKARKAPQFSKR

SEQ ID NO: 1268 - protein, 101 aa, Bacillus subtilis
AKQKIRIRLKAYDHRILDQSAEKIVETAKRSGASVSGPIPLPTEKSVYTILLAVHKYKDSREQFEMRTHKRLIDIVNPTPQTVDALMRLDLPSGVDIEIKL

SEQ ID NO: 1269 - protein, 103 aa, Borrelia burgdorferi
MIAKDKIRVRLFSFDVKILDQSAESIVKAVQKAKAQIKGPIPLPTKIKKYTVLRSPHVNKKSREQFEMRTHKRLIDILEPTSALMDSLMKLELPAGVEVDIKQ

SEQ ID NO: 1270 - protein, 103 aa, Escherichia coli
MQNQRIRIRLKAFDHRLIDQATAEIVETAKRTGAQVRGPIPLPTRKERFTVLISPHVNKDARDQYEIRTHLRLVDIVEPTEKTVDALMRLDLAAGVDVQISLG

SEQ ID NO: 1271 - protein, 118 aa, Haemophilus influenzae
MLVFLLAKFYWSSGLMQNQRIRIRLKAFDHRLIDQSTAEIVETAKRTGAQVRGPIPLPTRKERFTVLISPHVNKDARDQYEIRTHKRLVDIVEPTEKTVDALMRLDLAAGVDVQISLG

SEQ ID NO: 1272 - protein, 104 aa, Helicobacter pylori
MEKIRLKLKAYDHRVLDRSVVAIVEAVKRSGSEIRGPIPLPTKNKRYTVLRSPHVNKDSREQFEIRVYSRLIDIISATPETVDSLMKLDLAPEVDVEVTSMETK

SEQ ID NO: 1273 - protein, 165 aa, Homo sapiens
MLMPKKNRIAIYELLFKEGVMVAKKDVHMPKHPELADKNVPNLHVMKAMQSLKSRGYVKEQFAWRHFYWYLTNEGIQYLRDYLHLPPEIVPATLRRSRPETGRPRPKGLEGERPARLTRGEADRDTYRRSAVPPGADKKAEAGAGSATEFQFRGGFGRGRGQPPQ

SEQ ID NO: 1274 - protein, 106 aa, Methanococcus jannaschii
MRGESMQRARIKLSSTDHKVLDEICRQIKEIAEKTGVDISGPIPLPTKVLRVVTRKSPDGEGSSTFDRWTMKIHKRLIDIDADERALRHIMKIRIPDNVQIEIQFK

SEQ ID NO: 1275 - protein, 102 aa, Methanobacterium thermoautotrophicum
MHKARIKLTGTDPEKLAYVCDQLKKIAERTGVDMSGPIPLPTKRLVVPTRKSPDGEGTATWEKWEMRIHKRLVGIEADERAMRQVMKVNVPDNVSIEIELKS

SEQ ID NO: 1276 - protein, 91 aa, Methanococcus vannielii
MQKARIKLSSTKHEELDSVCNQIKAIAEKTGVDMAGPIPLPTKSLKITTRKSTDGEGSSSFDRWTMRVHKRVIDIEADERTMKHIMKVKNS

SEQ ID NO: 1277 - protein, 102 aa, Mycoplasma capricolum
MAENKMRIKLKGYDHAIVDQSITKIIQAAEGTGAKVRGPIPLPTEKQVITILRAVHKYKDSREQFEMRTHKRLLEILNPTAATMDVLKRVQLPSGVDIEIKL

SEQ ID NO: 1278 - protein, 106 aa, Mycoplasma genitalium
MNSAVKYPELKIKLESYDSTLLDLTIKKIVEVVKGVNIKIKGPLPLPTKKEVITIIRSPHVDKASREQFEKNTHKRLMILVDVNQGGIDSLKKIKIPVGVTLRFSK

SEQ ID NO: 1279 - protein, 101 aa, Mycobacterium leprae
MAGQKIRIRLKAYDHEAIDASARKIVETVVRTGANVVGPVPLPTEKNVYCVIRSPHKYKDSREHFEMRTHKRLIDILDPTPKTVDALMRIDLPASVDVNIQ

SEQ ID NO: 1280 - protein, 108 aa, Mycoplasma pneumoniae
MNAANAVKYPELKIKLESYDSTLLDLTTKKIVEVVKGVDVKIKGPLPLPTKKEVITIIRSPHVDKASREQFEKNRHKRLMILVDVNQGAIDSLKRIKIPVGVTLRFSK

SEQ ID NO: 1281 - protein, 101 aa, Mycobacterium tuberculosis
MAGQKIRIRLKAYDHEAIDASARKIVETVVRTGASVVGPVPLPTEKNVYCVIRSPHKYKDSREHFEMRTHKRLIDIIDPTPKTVDALMRIDLPASVDVNIQ

SEQ ID NO: 1282 - protein, 103 aa, Neisseria gonorrhoeae
MQTQKIRIRLKAYDYALIDRSAQEIVETAKRTGAVVKGPIPLPTKIERFNILRSPHMNKTSREQLEIRTHLRLMDIVDWTDKTTDALMKLDLPAGVDVEIKVQ

SEQ ID NO: 1283 - protein, 102 aa, Planobispora rosea
MAGQKIRIRLKAYDHEVIDSSAKKIVETVTRTGAKVAGPVPLPTEKNVYCVIRSPHNDKDSREHFEMRTHKRLIDIIDPTPKTVDSLMRLDLPAGVDISIKL

SEQ ID NO: 1284 - protein, 102 aa, Pyrococcus woesei
MQKARIKIASTNVRSLDEVANQIKQIAERTGVRMSGPIPLPTKRIRITTRKSPDGEGSATFDRWELRVHKRLIDIEADERAMRQIMRIRVPEDVTIEIELIS

SEQ ID NO: 1285 - protein, 165 aa, Rattus norvegicus
MLMPKKNRIAIYELLFKEGVMVAKKDVHMPKHPELADKNVPNLHVMKAMQSLKSRGYVKEQFAWRHFYWYLTNEGIQYLRDYLHLPPEIVPATLRRSRPETGRPRPKGPEGERPARFTRGEADRDTYRRSAVPPGADKKAEAGAGSATEFQFRGGFGRGRGQPPQ

SEQ ID NO: 1286 - protein, 105 aa, Rickettsia prowazekii
MKNKIKIRLKSFDHRSLDQATKEIVSAVKRTFATINGPIPLPRKIERFTVNRSPHVHKKSREQFEIRKHKRLLVIDDPNPAVVDALSKVDLAAGVDVVIELESGE

SEQ ID NO: 1287 - protein, 105 aa, Spirulina platensis
MATIQQQKIRIRLKAFDRRLLDTSCEKIVDTANRTGATALGPIPLPTKRRIYCVLRSPHVDKDSREHFETRTHRRIIDIYQPSSKTIDALMKLDLPAGVDIEVKL

SEQ ID NO: 1288 - protein, 102 aa, Streptococcus mutans
MANKKIRIRLKAYEHRTLDTAAEKIVETATRTGASVAGPVPLPTERSLYTVIRATHKYKDSREQFEMRTHKRLIDIVNPTQKTVDALMKLDLPSGVNVEIKL

SEQ ID NO: 1289 - protein, 102 aa, Sulfolobus acidocaldarius
MPTKARIRLWSSNIDSLNFVVNQIRNMAQKTGIQVSGPIPLPTTRMEVPVMRLPHGEGKKKWEHWEMKVHKRIIDIAADERVMRQLMRVRVPDDVYIEIELI

SEQ ID NO: 1290 - protein, 102 aa, Sulfolobus solfataricus
MPTKARIRLWSTNVENLNYVITQIRGIVEKTGIEMRGPIPLPTSKLEVPIMRLPHGEGRKKWEKWEMRVHKRLIDIAADERVMRQLMRVRVPEDVYIEIQLI

SEQ ID NO: 1291 - protein, 105 aa, Synechocystis sp. (strain PCC 6803)
MATLQQQKIRIRLKAFDRRLLDTSCDKIVDTANRTNAAAVGPIPLPTKRKIYCVLRSPHVDKDSREHFETRTHRRIIDIYQPSSKTIDALMKLDLPAGVDIEVKL

SEQ ID NO: 1292 - protein, 104 aa, Thermoplasma acidophilum
MVSYKARISLSGTEHRVVDRVCNEIKEIASRTGVEIHGPMPLPTKRLVVPVRKSPDGEGTNTWDHWEMRIHKRLIDVDADERTLRQLMRIPIPDGVQIEIQIKS

SEQ ID NO: 1293 - protein, 102 aa, Thermotoga maritima
MPGQKIRIKLKAYDHELLDESAKKIVEVAKSTNSKVSGPIPLPTERTLYCVLRSPMKHKDSREHFEKRVHKRLIDIIDPSPKTIDALMRINLPAGVDVEIKL

SEQ ID NO: 1294 - protein, 104 aa, Thermus aquaticus (subsp. thermophilus)
PKIRIKLRGFDHKTLDASAQKIVEAARRSGAQVSGPIPLPTRVRRFTVIRGPFKHKDSREHFELRTHNRLVDIINPNRKTIEQLMTLDLPTGVEIEIKTVGGGR

SEQ ID NO: 1295 - protein, 101 aa, Treponema hyodysenteriae
MKEQKIRVKLKAFDIELIDQSAQSIVASVKKTGARVSGPIPLPTSIRKVTVIRSPHVNIKSREQFEMRIYKRLIDIFDVTPQTTESLKKLALPAGVDVQLK

SEQ ID NO: 1296 - protein, 165 aa, Xenopus laevis
MLMPKKDRIAIYELLFKEGVMVAKKDVHMPKHPELADKNVPNLHVMKAMQSLKSRGYVKEQFAWRHFYWYLTNEGIQYLRDFLHLPPEIVPATLRRSRPETGRPRPKGLEGERPPRLPRGETDRDTYRRSAVPSGADKKAEAGAGAATEFQFRGGFGRGRGQAPQ

SEQ ID NO: 1297 - protein, 151 aa, Anopheles gambiae
MADQQNIRAFQKQLGINLNRKNVSRKKGLRMHHSIGLGFKTPKEAITGTYIDKKCPFTGHISIRGRILTGVVRKCIVLLYIRRDYLQFIRKYDTFEKRNRNMRLHLSPCFRDVEAGDIVTLGECRPLSKTVRFNVLKESKMAGSKKKFSKF

SEQ ID NO: 1298 - protein, 128 aa, Bacillus stearothermophilus
ARRTNTRKRRVRKNIDTGIAHIRSTFNNTIVTITDVHGNALAWASAGSLGFKGSRKSTPFAAQMAAEAAAKASMEHGMKTVEVNVKGPGAGREAAIRALQAAGLEITAIKDVTPIPHDGCRPPKRRRV

SEQ ID NO: 1299 - protein, 131 aa, Bacillus subtilis
MAAARKSNTRKRRVKKNIESGIAHIRSTFNNTIVTITDTHGNAISWSSAGALGFRGSRKSTPFAAQMAAETAAKGSIEHGLKTLEVTVKGPGSGREAAIRALQAAGLEVTAIRDVTPVPHNGCRPPKRRRV

SEQ ID NO: 1300 - protein, 132 aa, Chlamydia trachomatis
MVKNQAQKRGVKRKQVKNIPSGVVHVKATFNNTIVTITDPAGNVISWASAGKVGYPGSRKSSAFAATVAAQDAAKAAMSSGLKEVEVGLKGTGAGRESAVRALISSGLIVSVIRDETPVPHNGCRPRKRRRV

SEQ ID NO: 1301 - protein, 157 aa, Dunaliella tertiolecta
MAEQTEKAFQKQVGVTGCFKSKEKKAPGKSGHRFFKNVGLNFKTPKEAIDGNYVDKKCPFTGNVSIRGRILTGVVKSSKMMRTIIVRRDYLHFIPKYARYEKRHTNIPAHVSPCFRVRDGDTVIIGQCRPLSKTIRFNVLRVIPQAGATGKKSFSGF

SEQ ID NO: 1302 - protein, 128 aa, Escherichia coli
AKAPIRARKRVRKQVSDGVAHIHASFNNTIVTITDRQGNALGWATAGGSGFRGSRKSTPFAAQVAAERCADAVKEYGIKNLEVMVKGPGPGRESTIRALNAAGFRITNITDVTPIPHNGCRPPKKRRV

SEQ ID NO: 1303 - protein, 128 aa, Haemophilus influenzae
AKTPVRARKRVKKQVVDGVRHIHASFNNTIVTITDRQGNALAWATAGGSGFRGSRKSTPFAAQVAAERCAEIVKEFGLKNLEVMVKGPGPGRESTIRALNAAGFRITNITDVTPIPHNGCRPPKKRRV

SEQ ID NO: 1304 - protein, 131 aa, Helicobacter pylori
MAKRNVTAKKKVVKKNIARGVVYISATFNNTNITITDEMGNVICWSTAGGLGFKGSKKSTPYAAQQAVESALSKAKEHGVKEVGIKVQGPGSGRETAIKSVGATEGIKVLWIKDITPLPHNGCRPPKRRRV

SEQ ID NO: 1305 - protein, 158 aa, Homo sapiens [sequence omitted]

SEQ ID NO: 1306 - protein, 159 aa, Zea mays
MAEQTEKAFLKQPKVFLSSKKSGKGKKPGKGGNRFWKSIGLGFKTPREAIEGTYIDKKCPFTGTVSIRGRIIAGTCHSAKMNRTIIVRRNYLHFVKKYQRYEKRHSNIPAHISPCFRVKEGDHVIIGQCRPLSKTVRFNVVKVIPAGSAAAGKKAFTAA

SEQ ID NO: 1307 - protein, 129 aa, Methanococcus jannaschii
MAEQKKEKWGIVHIYSSYNNTIIHATDITGAETIARVSGGRVTRNQRDEGSPYAAMQAAFKLAEVLKERGIENIHIKVRAPGGSGQKNPGPGAQAAIRALARAGLRIGRIEDVTPVPHDGTTPKKRFKK

SEQ ID NO: 1308 - protein, 130 aa, Methanobacterium thermoautotrophicum
MAEKEKWGIANIYSSFNNTIITITDITGAETITQWSGGKVVRADRQESSPFAAMEAATRAADDAKEKGIVGLHIKVRAPGGNGPRTPGPGAQAAIRALARAGMRIGKIEDVTPIPHDGTGRPGGKRGRRV

SEQ ID NO: 1309 - protein, 131 aa, Mycoplasma genitalium
MAKKKKINVPSGLIHVSCSPNNTIVSATDPSGNVLCWASSGTVGFKGFRKKTPYSAGVAADKVAKTVKEMGMGSVKMYLKGTGRGKDTTIRSFANAGITITEINEKTPIPHNGCKLLSVRANQNNNLWKNF

SEQ ID NO: 1310 - protein, 121 aa, Mycoplasma pneumoniae
MAKKKKINVSSGIIHVSCSPNNTIVSASDPGGNVLCWASSGTMGFKGSRKKTPYSAGIAADKVAKTVKEMGMATVKLFVKGTGRGKDTAIRSFANAGLSITEINEKTPIPHNGCKPPKRPR

SEQ ID NO: 1311 - protein, 152 aa, Schizosaccharomyces pombe
MATELVVQSERAFQKQPHIFQNAKKGAGRRWYKDVGLGFKTPAEAIYGEYVDKKCPFVGQVSIRGRILTGTVVSTKMHRTIIIRREYLHFIPKYNRYEKRHKNLAAHVSPAFRINEGDVVTVGQCRPLSKTVRFNVLRVVKHTEGPKQFGKF

SEQ ID NO: 1312 - protein, 159 aa, Glycine max
MAEQTEKAFLKQPKVFLSTKKTGKGKRPGKGGNRFWKSIGLGFKTPREAIEGTYIDKKCPFTGNVSIRGRILAGTCHSAKMNRTIIVRRNYLHFIKKYQRYEKRHSNIPAHISPAFRVKEGDHVIIGQCRPLSKTVRFNVLKVIPAGSSSGAKKAFTGM

SEQ ID NO: 1313 - protein, 132 aa, Sulfolobus acidocaldarius
MSSRREIRWGNARIYASQNNTIITITDITGAEIISKASGGMVVKADREKPSPYAAMLAANKAANDAFDKGISAIHIKVRAQGGYGFQTPGPGAQPAIRALARAGFIIGRIEDVTPLPHDTIRRPGGRRGRRV

SEQ ID NO: 1314 - protein, 132 aa, Sulfolobus solfataricus
MSSRREIRWGIAHIYASQNNTLLTISDLTGAEIISRASGGMVVKADREKSSPYAAMLAANKAASDALEKGIMALHIKVRAPGGYGSKTPGPGAQPAIRALARAGFIIGRIEDVTPIPHDTIRRPGGRRGRRV

SEQ ID NO: 1315 - protein, 130 aa, Synechococcus sp. (strain PCC 6301)
MARPTKKSGPRKQKRNVPSGVAHIQSTFNNTIVSIADPAGEVISWASAGSSGFKGAKKGTPFAAQTAAEAAARRAIDQGMRQLEVMVSGPGSGRETAIRALQSAGLEITLIRDVTPIPHNGCRPPKRRRV

SEQ ID NO: 1316 - protein, 130 aa, Synechocystis sp. (strain PCC 6803)
MARPTRKTGPKKAKKNVPSGVAHIQSTFNNTIVTISDIRGDVISWASAGSSGFKGAKKGTPYAAQTAADSAARRAMEQGMRQLEVMVSGPGAGRETAIRALQGAGLEITLIRDVTPIPHNGCRPPKRRRV

SEQ ID NO: 1317 - protein, 158 aa, Xenopus laevis
MADIQTERAYQKQPTIFQNKKRVLEGETGKEKLPRYYRSVGLGFKTPREAIDGTYIDKKCPFTGNVSIRGRILSGVVTKMKMQRTIVIRRDYLHYIRKYNRFEKRHKNMSVHLSPCFRDVQVGDTVTVGECRPLSKTVRFNVLKVTKAAGTKKQFQKF

SEQ ID NO: 1318 - protein, 124 aa, Anacystis nidulans
MPTIQQLIRDEREKITKKTKSPALKNCPQRRGVCTRVYTTTPKKPNSALRKVARVRLTSGFEVTAYIPGIGHNLQEHSVVMIRGGRVKDLPGVRYHIIRGTLDTAGVKDRRQSRSKYGAKRPKA

SEQ ID NO: 1319 - protein, 139 aa, Bacillus stearothermophilus
PTINQLVRKGREKKVFKSKSPALNKGYNSFKKEQTNVASPQKRGVCTRVGTMTPKKPNSALRKYARVRLTNGIEVTAYIPGIGHNLQEHSVVLIRGGRVKDLRGVRYHIIRGGLDTAGVANRMQGRSKYGAKKPKAAKK

SEQ ID NO: 1320 - protein, 137 aa, Bacillus subtilis
PTINQLIRKGRVSKVENSKSPALNKGYNSFKKEHTNVSSPQKRGVCTRVGTMTPKKPNSALRKYARVRLTNGIEVTAYIPGIGHNLQEHSVVLIRGGRVKNLPRVRYHIVRGALDTAGVENRAQGRPKYGTKKPKAK

SEQ ID NO: 1321 - protein, 145 aa, Caenorhabditis elegans
MKAIKILDNFRDVQVAPAAVAQGPMDKEGALRAVLRAAHHADGLAKGLHETCKALDKREAHFCVLAENCDEPQYVKLVETLCAEHQIPLIKVADKKIIGEYCGLCKYDKEGKARKVVGCSSAVVTNWGNEEQGRAILTDYFASKN

SEQ ID NO: 1322 - protein, 123 aa, Escherichia coli
ATVNQLVRKPRARKVAKSNVPALEACPQKRGVCTRVYTTTPKKPNSALRKVCRVRLTNGFEVTSYIGGEGHNLQEHSVILIRGGRVKDLPGVRYHTVRGALDCSGVKDRKQARSKYGVKRPKA

SEQ ID NO: 1323 - protein, 124 aa, Erwinia amylovora
MATVNQLVRKPRVRKVAKSNVPALEACPQKRGVCTRVYTTTPKKPNSALRKVCRVRLTNGFEVTSYIGGEGHNLQEHSVILIRGGRVKDLPGVRYHTVRGALDCSGVKDRKQARSKYGVKNAKA

SEQ ID NO: 1324 - protein, 123 aa, Haemophilus influenzae
ATINQLVRKPRVKKVVKSNVPALEACPQKRGVCTRVYTTTPKKPNSALRKVCRIRLTNGFEVTSYIGGEGHNLQEHSVVLIRGGRVKDLPGVRYHTVRGALDCAGVKDRKQGRSKYGVKRPKA

SEQ ID NO: 1325 - protein, 142 aa, Halobacterium halobium
MTNGKYAARKLKKDRQQRRWSDSEYARRERGLGKKSDPLEGAPQGRGIVLEKVGIEAKQPNSAIRKCVRVQLIKNGKQVTAFCPGDGAISFIDEHDEVTIAGIGGAKGRAMGDLSGVNYKVEKVNGVSLIELVRGNAEKPVR

SEQ ID NO: 1326 - protein, 142 aa, Halococcus morrhuae
MANGKYAARKLKKDRQNHRWSDSKYARRARGLKEKTDALEGAPQGRGIVLEKVGIEAKQPNSAIRKCVRVQLIKNGQQVTAFCPGDGAISFIDEHDEVTIAGIGGAKGRAMGDLSAVNYKVEKVNGVSLIELVRGNAEKPVR

SEQ ID NO: 1327 - protein, 135 aa, Helicobacter pylori
MPTINQLIRKERKKVVKKTKSPALVECPQRRGVCTRVYTTTPKKPNSALRKVAKVRLTSKFEVISYIPGEGHNLQEHSIVLVRGGRVKDLPGVKYHIVRGALDTAGVNKRTVSRSKYGTKKAKATDKKATDNKKK

SEQ ID NO: 1328 - protein, 124 aa, Leptospira biflexa
MPTINQLIRIGREDQKKRTKSPALKACPQRRGVCTRVMTFTPKKPNSALRKVARVRLTTGIEVTAYIPGEGHNLQEHNVVLIRGGRVKDLPGVRYHIIRGTLDTLGVDKRRKGRSKYGAKRPKA

SEQ ID NO: 1329 - protein, 148 aa, Methanococcus jannaschii
MSGSKSPRGEFAGRKLRLKRKWCRWHDYNYVRRVLKLKEKYDPLEGAPMARGIVIEKVGLEAKQPNSAIRKCVRVQLIKNGRVVTAFCPGNHAINFIDEHDEVIIEGIGGPKGPRAKGDIPGVKYKVIMVGRNSLRELVRGRQEKIKR

SEQ ID NO: 1330 - protein, 141 aa, Methanobacterium thermoautotrophicum
MPGLFAAKKLKSKRQKFKWKDTHYKRRSLRLDVKADPLEGAPQARGIVIEKVGIEAKQPNSAIRKCVRVQLIKNGKQITAFAPGDGAIGFIDEHDEVVVEGIGGPSGRSMGDIPGVRWKVTKVNNVSLQEMVKGKIEKPVR

SEQ ID NO: 1331 - protein, 147 aa, Methanococcus vannielii
MSGSKSPKGEFAGRKLLLKRKATRWQHYKYVNRELGLKVKADPLGGAPMGRGIVVEKVGLEAKQPNSAIRKCVKVQLIKNGRVVTAFAPGNHAINFIDEHDEVVIEGIGGPSGQAKGDIPGVRYKVLMVGKNSIRELVRGRQEKVKR

SEQ ID NO: 1332 - protein, 124 aa, Micrococcus luteus
MPTIQQLVRKGRSPKVVNTNGPALQGNPMRRGVCTRVYTTTPTKPNSAVRKVARVRLNGGIEVTAYIPGEGHNLQEHSIVLVRGGRVKDLPGVRYKIVRGALDTQGVKNRGQARSRYGAKKEKK

SEQ ID NO: 1333 - protein, 124 aa, Mycobacterium bovis
MPTIQQLVRKGRRDKISKVKTAAPKGSPQRRRVCNRVYTTTPKKPNSALRKVARVKLTSQVEVTAYIPGEGHNLQEHSMVLVRGGRVKDLPGVQYKIIRGSLDTQGVKNRKQARSRYGAKKEKG

SEQ ID NO: 1334 - protein, 139 aa, Mycoplasma genitalium
MATIAQLIRKPRQKKKVKSKSPALHYNLNLLNKKTTNVYSPLKRGVCTRVGTMTPRKPNSALRKYAKVRLTNGFEVLAYIPGEGHNLQEHSVTLLRGGRVKDLPGVRYHIVRGTLDTVGVDKRRQQRSAYGAKKPKPKS

SEQ ID NO: 1335 - protein, 124 aa, Mycobacterium intracellulare
MPTIQQLVRKGRRDKVAKVKTAALKGSPQRRGVCTRVYTTTPKKPNSALRKVARVKLTSQVEVTAYIPGEGHNLQEHSMVLVRGGRVKDLPGVRYKIIRGSLDTQGVKNRKQARSRYGAKKEKS

SEQ ID NO: 1336 - protein, 124 aa, Mycobacterium leprae
MPTIQQLVRKGRRDKIGKVKTAALKGNPQRRGVCTRVYTSTPKKPNSRLRKVARVKLTSQVEVTAYIPGEGHNLQEHSMVLVRGGRVKDLPGVRYKIIRGSLDTQGVKNRKQARSRYGAKKEKS

SEQ ID NO: 1337 - protein, 139 aa, Mycoplasma pneumoniae
MATIAQLIRKPRKKKKVKSKSPALHYNLNLLNKKVTNVYSPLKRGVCTRVGTMTPKKPNSALRKYAKVRLTNGFEVLTYIPGEGHNLQEHSVTLLRGGRVKDLPGVRYHIVRGTLDTVGVEKRRQQRSAYGAKKPKAKS

SEQ ID NO: 1338 - protein, 124 aa, Mycobacterium smegmatis
MPTIQQLVRKGRRDKIAKVKTAALKGSPQRRGVCTRVYTTTPKKPNSALRKVARVKLTSQVEVTAYIPGEGHNLQEHSMVLVRGGRVKDLPGVRYKIIRGSLDTQGVKNRKQARSRYGAKKEKS

SEQ ID NO: 1339 - protein, 124 aa, Mycobacterium tuberculosis
MPTIQQLVRKGRRDKISKVKTAALKGSPQRRGVCTRVYTTTPKKPNSALRKVARVKLTSQVEVTAYIPGEGHNLQEHSMVLVRGGRVKDLPGVRYKIIRGSLDTQGVKNRKQARSRYGAKKEKG

SEQ ID NO: 1340 - protein, 131 aa, Sus scrofa
AEEGIAAGGVMDVNTALQEVLKTALIHDGLARGIREAAKALDKRQAHLCVLASNCDEPMYVKLVEALCAEHQINLIKVDDNKKLGEWVGLCKIDREGKPRKVVGCSCVVVKDYGKESQAKDVIEEYFKCKK

SEQ ID NO: 1341 - protein, 131 aa, Rattus norvegicus
AEEGIAAGGVMDVNTALQEVLKTALIHDGLARGIREAAKALDKRQAHLCVLASNCDEPMYVKLVEALLAEHQINLIKVDDNKKLGEWVGLCKIDREGKPRKVVGCSCVVVKDYGKESQAKDVIEEYFKCKK

SEQ ID NO: 1342 - protein, 129 aa, Rickettsia prowazekii
MPTYNQLVRFGRKSKTRKTKSPALESNPFKSGVCLVVKTVTPKKPNSALRKIATVRLSNKRTVNAYIPGEKHSVKEHDRVLVRGGQVPDLPGVKYHIVLGAYDIAGVKGRKQGRSRYGAHRKQVAATKK

SEQ ID NO: 1343 - protein, 124 aa, Spirulina platensis
MPTIQQLIRSAREKTDKKTKSPALKSCPQRRGVCTRVYTTTPKKPNSALRKVARVRLTSGFEVTAYIPGIGHNLQEHSVVMIRGGRVKDLPGVRYHIIRGTLDTAGVKDRRNGRSKYGAKRPKA

SEQ ID NO: 1344 - protein, 137 aa, Staphylococcus aureus
MPTINQLVRKPRQSKIKKSDSPALNKGFNSKKKKFTDLNSPQKRGVCTRVGTMTPKKPNSALRKYARVRLSNNIEINAYIPGIGHNLQEHSVVLVRGGRVKDLPGVRYHIVRGALDTSGVDGRRQGRSLYGTKKPKN

SEQ ID NO: 1345 - protein, 137 aa, Streptococcus pneumoniae
MPTINQLVRKPRKSKVEKSKSPALNVGYNSHKKVQTNVSSPQKRGVATRVGTMTPKKPNSALRKFARVRLSNLIEVTAYIPGIGHNLQEHSVVLLRGGRVKDLPGVRYHIVRGALDTAGVNDRKQGRSKYGTKRPKA

SEQ ID NO: 1346 - protein, 151 aa, Sulfolobus acidocaldarius
MAGSKSPKGLFAARKLRLKRLKFSWSQRSFKRRMLALKEKFDPLEGAPMARGIVLEKVGIESRQPNSAVRKAVRVQLVKNGRIVTAFVPGDGGVNFIDEHDEVVIAGIGGTLGRSMGDLPGVRYKVVMVNGVSLDALYKGKEAETSKINFR

SEQ ID NO: 1347 - protein, 147 aa, Sulfolobus solfataricus
MSKSKSSKGIYSARKLRLKRLKFRRSQRKYKTKILKLKEKYNPLGGAPMARGIVLEKVGIESRQPNSAVRKCVRVQLVRNGRVVTAFVPGDGGVNFIDEHDEVIITGIGGTLGRSMGDLPGVRYKVINGNGVSLDALYKGKKQKPVR

SEQ ID NO: 1348 - protein, 126 aa, Synechocystis sp. (strain PCC 6803)
MPTIQQLIRSERSKVQKKTKSPALKQCPQRRGVCTRVYTTTPKKPNSALRKVARVRLTSGFEVTAYIPGIGHNLQEHSVVLIRGGRVKDLPGVRYHIVRGTLDATGVKDRKQGRSKYGTKREKAKK

SEQ ID NO: 1349 - protein, 142 aa, Tetrahymena thermophila
MGVGKPRGIRAGRKLARHRKDQRWADNDFNKRLLGSRWRNPFMGASHAKGLVTEKIGIESKQPNSAVRKCVRVLLRKNSKKIAAFVPMDGCLNFLAENDEVLVAGLGRQGHAVGDIPGVRFKVVCVKGISLLALFKGKKEKR

SEQ ID NO: 1350 - protein, 147 aa, Thermococcus celer
MAGKKAPYGEFAGRKLKLKRKKFRWSDIRYKRRVLRLKEKSDPLEGAPQAKGIVLEKIAVEAKQPNSAMRKAVRVQLIKNGKVVTAFTPGDGAINHIDEHDEVIIEGIGGPKGGSMGDIPGIRYKVVKVNRVSLKELVKGRKEKPRR

SEQ ID NO: 1351 - protein, 135 aa, Thermus aquaticus (subsp. thermophilus)
MVALPTINQLVRKGREKVRKKSKVPALKGAPFRRGVCTVVRTVTPKKPNSALRKVAKVRLTSGYEVTAYIPGEGHNLQEHSVVLIRGGRVKDLPGVRYHIVRGVYDAAGVKDRKKSRSKYGTKKPKEAAKTAAKK

SEQ ID NO: 1352 - protein, 131 aa, Xenopus laevis
AEEGISAGGVMDVNTALQEVLKTALIHDGLARGIREAAKALDKRQAHLCVLASNCDEPMYVKLVEALCAEPQINLIKVDDNKKLGEWVGLCKIDREGKPRKVVGCSCVVVKDYGKESQAKDVIEEYFKIKK

SEQ ID NO: 1353 - protein, 151 aa, Agaricus bisporus
MGRMHAPGKGISSSALPYRRTPPSWLKTTSEEVVEQIVKLARKGLTPSQIGVTLRNSHGIPQVRFVTGNKILRILKSQGLGPSIPEDLWHLIKKAVAVRKHMETNRKDKDSKFRLILIESRIHRLARYYKTKQQIPPTFKYDSATASTLIA

SEQ ID NO: 1354 - protein, 150 aa, Anopheles gambiae
GRMHAPGKGISKSALPYRRSVPSWLKLSAEDVKEQIKKLGKKGMTPSQIGIILRDSHGVAQVRFVNGNKVLRIMKAVGLKPDIPEDLYFLIKKAVSIRKHLERNRKDIDSKFRLILIESRIHRLARYYKIKAVLPPNWKYESSTASALVA

SEQ ID NO: 1355 - protein, 119 aa, Bacillus stearothermophilus
ARIAGVDIPRDKRVVISLTYIYGIGKPTAQILKEAGVSEDTRVRDLTEEELGRIREIVGRLKVEGDLRREVSLNIKRLMEIGCYRGLRHRRGLPVRGQNTKNNARTRKGPRRTVANKKK

SEQ ID NO: 1356 - protein, 120 aa, Bacillus subtilis
ARIAGVDIPRDKRVVISLTYIFGIGRTTAQQVLKEAGVSEDTRVRDLTEEELGKIRDIIDKLKVEGDLRREVSLNIKRLIEIGSYRGIRHRRGLPVRGQNSKNNARTRKGPRRTVANKKK

SEQ ID NO: 1357 - protein, 150 aa, Brugia pahangi
GRMHNPGKGISQSALPYRRSVPTWLKLTSEEVQEQVTRLAKKGLRPSQIGVILRDSHGVAQVRRVTGNKIVRILKAKGMAPEIPEDLYHLIKKAVNIRKHLERNRKDKDSKYRLILVESRIHRLARYYKTKRQLPATWKYESSTASALVS

SEQ ID NO: 1358 - protein, 150 aa, Caenorhabditis elegans
GRMHNPGKGMAKSAIPYRRSVPSWQKMTAEEVQDQIVKMAKKGLRPSQIGVILRDSHGVGQVRRLAGNKIFRILKSKGMAPELPEDLYHLVKKAVAIRKHLERSRKDIDSKYRLILVESRIHRLARYYKTKRQLPPTWKYESGTAASLVS

SEQ ID NO: 1359 - protein, 150 aa, Candida maltosa
GRMHSAGKGISSSAIPYSRNAPSWFKLSSDEVVEQVIKYARKGLTPSQIGVILRDAHGVSQAKIVTGNKVLRILKSNGLAPELPEDLYFLIKKAVAVRKHLERNRKDKDSKFRLILIESRIHRLARYYRTVSVLPPNWKYESATASALVA

SEQ ID NO: 1360 - protein, 118 aa, Chlamydia trachomatis
ARVLNIEIPNNKKARISLTYIFGIGPTIAKQILADANVDGEKRVKELTEEELTRIRDEAKKYTTEGDLKREINLNIKRLMEIKSYRVIRHRKDTCKRSTKKNARTRKGPKKDNRWKER

SEQ ID NO: 1361 - protein, 150 aa, Drosophila melanogaster
GRMHAPGKGISQSALPYRRTVPSWLKLNADDVKEQIKKLGKKGLTPSKIGIILRDSHGVAQVRFVNGNKILRIMKSVGLKPDIPEDLYHMIKKAVAIRKHLERNRKDKDGKFRLILVESRIHRLARYYKTKSVLPPNWKYESSTASALVA

SEQ ID NO: 1362 - protein, 117 aa, Escherichia coli
ARIAGINIPDHKHAVIALTSIYGVGKTRSKAILAAAGIAEDVKISELSEGQIDTLRDEVAKFVVEGDLRREISMSIKRLMDLGCYRGLRHRRGLPVRGQRTKTNARTRKGPRKPIKK

SEQ ID NO: 1363 - protein, 121 aa, Haemophilus influenzae
ARIAGINIPDHKHAVIALTAIYGIGKTRSQAICAAAGIAEDVKIRELSEEQIDKLRDEVGKFTVEGDLRREVTLNIKRLLDLGCYRGLRHRRSLPVRGQRTKTNARTRKVHVSRSKNSRGK

SEQ ID NO: 1364 - protein, 120 aa, Helicobacter pylori
MARIAGVDLPKKKRVEYALTYIYGIGLKSSREILEAVGISFDKRVHELSEDEVSSIAKKIQQSYLVEGDLRKKVQMDIKSLMDLGNYRGIRHRKGLPVRGQTTKNNARTRKGKKKTVGSK

SEQ ID NO: 1365 - protein, 150 aa, Homo sapiens
GRMHAPGKGLSQSALPYRRSVPTWLKLTSDDVKEQIYKLAKKGLTPSQIGVILRDSHGVAQVRFVTGNKILRILKSKGLAPDLPEDLYHLIKKAVAVRKHLERNRKDKDAKFRLILIESRIHRLARYYKTKRVLPPNWKYESSTASALVA

SEQ ID NO: 1366 - protein, 150 aa, Ictalurus punctatus
GRMHAPGKGLSQSALPFRRSVPTWLKLTSDDVKEQIFKLAKKGLTPSQIGVILRDSHGVAQVRFVTGNKILRILKSKGLAPDLPEDLYHLITKDVAVRKHLERNRKDKDAKFRLILVESRIHRLARYYKTKRVLAPNWKYESSTASALVA

SEQ ID NO: 1367 - protein, 151 aa, Zea mays
MGAMHSRGKGISSSALPYKRTPPTWLKTAASDVEEMITKAAKKGQMPSQIGVLLRDQHGIPLVKSVTGSKILRILKAHGLAPEIPEDLYFLIKKAVAIRKHLERNRKDKDSKFRLILVESRIHRLARYYKRTKKLPPTWKYESTTASTLVA

SEQ ID NO: 1368 - protein, 150 aa, Methanococcus jannaschii
MQNSEFKYLIRVSRTDLDGNKKLIMALQDIYGVGEAMARAIVRVAKLDPNKLAGYLTEEEVKKIEEVLADPAKFGIPSWMFNRRKDYVTGEDKHVIESDLMIIKQEDINRLKRIRCYRGIRHELGLPCRGQRTKSTFRRGPTVGVSRRKK

SEQ ID NO: 1369 - protein, 149 aa, Methanobacterium thermoautotrophicum
MEEEFKHMVRIARKDIDGNKTMENALTSIKGVGKALSRAIIMSAGYDLNQRIGYLSDEEIERLEEAIKNPAKYNIPSWMINRRNDYETGEDKHLIESDLEMCLREDLNRMRKTRSYKGRRHELGLPVRGQRTKSTFRKGSSVGVRRKKR

SEQ ID NO: 1370 - protein, 123 aa, Mycobacterium bovis
MDRLVGVDLPRHKRMEVALTYIFGIGRTRSNEILAATGIDRDLRTRDLTEEQLIHLRDYIEANLKVEGDLRREVQADIRRKIEIGCYQGLRHRRGMPVRGQRTKTNARTRKGPKAHHRRQEEG

SEQ ID NO: 1371 - protein, 123 aa, Mycoplasma genitalium
ARILGIDIPNQKRIEIALTYIFGIGLSSAKTILKKAKINPDKRVKDLSEEELVAIRNAASGYKIEGDLRREIALNIKHLTEIGSWKGIRHRKNLPVRGQRTRTNARTRKGPRKTVANKKIESK

SEQ ID NO: 1372 - protein, 124 aa, Mycoplasma pneumoniae
MARILGIDIPNQKRIEIALTYIFGIGLSRSQAILKQANINPDKRVKDLTEEEFVAIRNVASAYKIEGDLRREIALNIKHLSEIGAWRGLRHRKNLPVRGQRTRTNARTRKGPRKTVANKKIESK

SEQ ID NO: 1373 - protein, 151 aa, Pisum sativum
MGRLHSKGKGISSSALPYRRTAPSWLKISSQDVDETICKFAKKGLTPSQIGVILRDSHGIAQVKSVTGSKILRILKAHGLAPEIPEDLYHLIKKAVSIRKHLERFRKDKDSKFRLILVESRIHRLARYYKKTKKLPPVWKYESTTASTLVA

SEQ ID NO: 1374 - protein, 150 aa, Schizosaccharomyces pombe
GRMHSKGKGIASSALPYVRSPPAWCKADADSVVEQILKFSKKGMSPSQIGVTLRDSHGIPQVRFITGQKIMRILKANGLAPELPEDLYNLIKKAVSVRKHLERNRKDKDSKFRLILIESRIHRLARYYRKVGALPPTWKYESATASALVA

SEQ ID NO: 1375 - protein, 165 aa, Sulfolobus solfataricus
MSQQFKYVVRIFGQDVDGTMKLPYALAMVKGIGYNTAKAIIRKLGMDPNARLGELSDAEVKKVESVISDHTIKGLPSWLYNRRKDYESGLDLHLVTSDLIFYVRNDIEREKKSRSWRGVRHSLGLKVRGQRTRTTGRTGMTIGVARKKAAQPQSQQSSSQQQKSS

SEQ ID NO: 1376 - protein, 125 aa, Synechococcus sp. (strain PCC 6301)
MARIAGVDLPRDKRAEIGLTYIYGIGPTRAKEILAKTGVSPDTRIKDLNDSEVAALRQVVENDYQVEGDLRRLEAMSIKRLMDIGTVRGRRHRAGLPVRGQRTRTNARTRRGARKTVAGKKKATR

SEQ ID NO: 1377 - protein, 127 aa, Synechocystis sp. (strain PCC 6803)
MARIAGVDLPRDKRVEIALTYLYGIGLSRSHEILDATGVSPDVRVKDLSDEDALKLRTYIDENYEIEGDLRRWEAMNIKRLGDIGTYRGRRHRQGLPVRGQRTRTNARTRRGRRLTVAGKKKTPAKK

SEQ ID NO: 1378 - protein, 150 aa, Xenopus laevis
GRMHAPGKGLSQSALPYRRSVPTWLKLTSDDVKEQIYKLAKKGLTPSQIGVILRDSHGVAQVRFVTGNKILRILKSKGLAPDLPEDLYHLIKKAVAVRKHLERNRKDKDAKFRLILIESRIHRLARYYKTRRVLPPNWKYESSTASALVA

SEQ ID NO: 1379 - protein, 150 aa, Saccharomyces cerevisiae
GRMHSAGKGISSSAIPYSRNAPAWFKLSSESVIEQIVKYARKGLTPSQIGVLLRDAHGVTQARVITGNKIMRILKSNGLAPEIPEDLYYLIKKAVSVRKHLERNRKDKDAKFRLILIESRIHRLARYYRTVAVLPPNWKYESATASALVN

SEQ ID NO: 1380 - protein, 101 aa, Acyrthosiphon kondoi symbiotic bacterium
MAKQSMKAREVKRVKLADKFFAKRAELKAIISDVNASDEDRWNAVLKLQTLPRDSSPSRQRNPCRQTGRPHGYVGKFGLSRIKLREAAMRGEVPGLKKASW

SEQ ID NO: 1381 - protein, 61 aa, Bacillus stearothermophilus
MAKKSMIIKQKRTPKFKVRAYTRCERCGRPHSVYRKFKLCRICFRELAYKGQLPGIKKASW

SEQ ID NO: 1382 - protein, 60 aa, Bacillus subtilis
AKKSMIAKQQRTPKFKVQEYTRCERCGRPHSVIRKFKLCRICFRELAYKGQIPGVKKASW

SEQ ID NO: 1383 - protein, 152 aa, Caenorhabditis elegans
MAPARKGKAKEEQAVVSLGPQAKEGELIFGVAHIFASFNDTFVHITDISGRETIVRVTGGMKVKADRDESSPYAAMLAAQDVADRCKQLGINALHIKLRATGGTRTKTPGPGAQSALRALARAGMKIGRIEDVTPIPSDCTRRKGGRRGRRL

SEQ ID NO: 1384 - protein, 153 aa, Chlamydomonas reinhardtii
MAPKKAAKGDEAPKEVVSLGPTVREGEHVFGVAHIFASFNDTFVHVTDLSGRETISRVTGGMKVKADRDESSPYAAMLAAQDVAQKCKELGITALHIKLRATGGNRTKTPGPGAQSALRALARAGMKIGRIEDVTPIPTDSTRRKGGRRGRRL

SEQ ID NO: 1385 - protein, 151 aa, Drosophila melanogaster
MAPRKAKVQKEEVQVQLGPQVRDGEIVFGVAHIYASFNDTFVHVTDLSGRETIARVTGGMKVKADRDEASPYAAMLAAQDVAEKCKTLGITALHIKLRATGGNKTKTPGPGAQSALRALARSSMKIGRIEDVTPIPSDSTRRKGGRRGRRL

SEQ ID NO: 1386 - protein, 100 aa, Escherichia coli [sequence omitted]

SEQ ID NO: 1387 - protein, 100 aa, Haemophilus influenzae
AKQSMKARDVKRVKLAEKFYAKRVELKKIISDVNASDEDRWDAVLKLQTLPRDSSPSRQRNRCRQTGRPHGVLRKFGLSRIKVREAAMRGEIPGLKKASW

SEQ ID NO: 1388 - protein, 61 aa, Helicobacter pylori
MAKKSMIAKAQRKPKFQVRAYTRCRICGRPHSVYRDFGLCRVCLRKMGSEGLIPGLRKASW

SEQ ID NO: 1389 - protein, 151 aa, Homo sapiens [sequence omitted]

SEQ ID NO: 1390 - protein, 137 aa, Kluyveromyces lactis
MANVVQAKDNSQVFGVARIFASFNDTFVHVTDLSGRETIARVTGGMKVKADRDESSPYAAMLAAQDVAAKCKEVGITAVHIKIRATGGTRSKTPGPGGQAALRALARSGLRIGRIEDVTPVPSDSTRKKGGRRGRRL

SEQ ID NO: 1391 - protein, 150 aa, Lupinus luteus
MSRRKVRDTKEETVTLGPAVSDGEHVFGVARIFASFNDTFIHVTDLSGRETLVRITGGMKVKADRDESSPYAAMLAAQDVATRCKELGITALHIKLRATGGNKTKTPGRGAQSALRALARSGMKIGRIEDVTPIPSDSTRRKSGRRGRRL

SEQ ID NO: 1392 - protein, 53 aa, Methanococcus jannaschii
MAKKPWKKKYGYGIRPCQRCGHVGPGLIRKYGLNLCRQCFREIAHKLGFKKLD

SEQ ID NO: 1393 - protein, 50 aa, Methanobacterium thermoautotrophicum
MIVLPRKYGKASRKCSRCGDHSALVRRYGLMLCRQCFRELAPKIGFKKYN

SEQ ID NO: 1394 - protein, 53 aa, Methanococcus vannielii
MTKEPFKTKYGQGSKVCKRCGRKGPGIIRKYGLDLCRQCFRELAPKLGFKKYD

SEQ ID NO: 1395 - protein, 60 aa, Mycoplasma capricolum
MAKKSLKVKQAKHPKFNVRNYTRCNHCGRPHAVLKKFGICRLCFRKFAYEGQIPGIKKAS

SEQ ID NO: 1396 - protein, 61 aa, Mycoplasma genitalium
MAKKSLKVKQSRPNKFSVRDYTRCLRCGRARAVLSHFGVCRLCFRELAYAGAIPGVKKASW

SEQ ID NO: 1397 - protein, 61 aa, Mycobacterium leprae
MAKKALVNKAARKPKFTVRGYTRCSKCGRPRAVFRKFGLCRICLREMAHAGELPGVQKSSW

SEQ ID NO: 1398 - protein, 61 aa, Mycoplasma pneumoniae
MAKKSLKVKQTRIPKFAVRAYTRCQRCGRARAVLSHFGVCRLCFRELAYAGAIPGVKKASW

SEQ ID NO: 1399 - protein, 152 aa, Neurospora crassa
MPPKKAARPAQENISLGPQIREGELVFGVARIFASFNDTFVHVTDLSSSGRETTDRVIGGIKVKADRDESSPYAAMLAAQDVAARCKELGITALHIKIRATGGNGTRTPGPGAQSALRALARSGMKIGRIEDVTPTPSDSTRRKGGRRGRRL

SEQ ID NO: 1400 - protein, 151 aa, Podocoryne carnea
MAPRKGKAPKEEQVISLGPQVADGENVFGVAHIFASFNDTFVHVTDLSGKETIARVTGGMKVKADRDESSPYAAMLAAQDVAVRCKEIGITALHVKLRATGGNRTKTPGPGAQSALRALARSGMKIGRIEDVTPIPSDCTRRKGGRRGRRL

SEQ ID NO: 1401 - protein, 151 aa, Procambarus clarkii
MAPRKGKVQKEEVQVQLGPQVLDGEKVFAVCHIYASYNDTFVHVTDLSGRETIVRITGGQKVKADRDESSPYAAMLAAQDVAEKCKSLGINCLHIKIRATGGNKTKTPGPGGQSALRALARAGMKIGRIEDVTPVPSDSTRRKGGRRGRRL

SEQ ID NO: 1402 - protein, 151 aa, Rattus norvegicus
MAPRKGKDKKEEQVISLGPQVAEGENVFGVCHIFASFNDTFVHVTDLSGKETICRVTGGMKVKADRDESSPYAAMLAAQDVAQRCKELGITALHIKLRATGGNRTKTPGPGAQSALRALARSGMKIGRIEDVTPIPSDSTRRKGGRRGRRL

SEQ ID NO: 1403 - protein, 100 aa, Synechococcus sp. (strain PCC 6301)
MAKKAMVERDRKRKKLVEKYAAKREALKEQFAAATSQSERLELHRKLQQLPRNSAPNRVRNRCWVTGRPRGYYRDFGLCRNVLREMAHQGLLPGVVKSSW

SEQ ID NO: 1404 - protein, 100 aa, Synechocystis sp. (strain PCC 6803)
MAKKSMIERDKRRSRLVAKYAAKREALKEEFRQAETLEDKLAVHQKLQDLPRNSAPNRRRNRCQVTGRPRSYYRDFGLCRNVLREWAHQGLLPGVTKSSW

SEQ ID NO: 1405 - protein, 60 aa, Thermus aquaticus (subsp. thermophilus)
ARKALIEKAKRTPKFKVRAYTRCVRCGRARSVYRFFGLCRICLRELAHKGQLPGVRKASW

SEQ ID NO: 1406 - protein, 144 aa, Trypanosoma brucei brucei
MSKKQEVKYYGSSAGKDQLVYGVVHIYASFNDTFVHVTDMSGRETFCKVTGGMKVKADRDESSPYAAMMAAQDVVARCKECGINALHVKMRATGGVGTKSPGPGAQAALRALARAGMKIGRIEDVTPVPTDSTRRKGSRRGRRL

SEQ ID NO: 1407 - protein, 152 aa, Arabidopsis thaliana
MADVEPEVAAAGVPKKRTFKKFAFKGVDLDALLDMSTDDLVKLFSSRIRRRFSRGLTRKPMALIKKLRKAKREAPQGEKPEPVRTHLRNMIIVPEMIGSIIGVYNGKTFNQVEIKPEMIGHYLAEFSISYKPVKHGRPGVGATHSSRFIPLK

SEQ ID NO: 1408 - protein, 88 aa, Bacillus stearothermophilus
ALTQERKREIIEQFKVHENDTGSPEVQIAILTEQINNLNEHLRVHKKDHHSRRGLLKMVGKRRRLLAYLRNKDVARYREIVEKLGLRR

SEQ ID NO: 1409 - protein, 88 aa, Bacillus subtilis
AITQERKNQLINEFKTHESDTGSPEVQIAILTDSINNLNEHLRTHKKDHHSRRGLLKMVGKRRNLLTYLRNKDVTRYRELINKLGLRR

SEQ ID NO: 1410 - protein, 90 aa, Campylobacter jejuni
MALDSAKKAEIVAKFAKKPGDTGSTEVQVALLTARIAELTEHLKIYKNDFSSRLGLLKLVGQRKRLLSYLKRKDYNSYSKLITELNLRDK

SEQ ID NO: 1411 - protein, 88 aa, Escherichia coli [sequence omitted]

SEQ ID NO: 1412 - protein, 88 aa, Haemophilus influenzae
SLSTEKKAAIVAEFGRDAKDTGSSEVQIALLTAQINHLQTHFAEHKKDHHGRRGLLRMVSRRRKLLDYLKRTDLALYQSTIARLGLRR

SEQ ID NO: 1413 - protein, 90 aa, Helicobacter pylori
MALNLEKKQEIIKAFATKENDTGSCEVQVALLNERIKLLTEHLKANPKDHSSRLGLLKLVAQRRNLLKYIKRTNHARYVVLIEKLGIKDR

SEQ ID NO: 1414 - protein, 144 aa, Homo sapiens
AEVEQKKKRTFRKFTYRGVDLDQLLDMSYEQLMQLYSARQRRRLNRGLRRKQHSLLKRLRKAKKEAPPMEKPEVVKTHLRDMIILPEMVGSMVGVYNGKTFNQVEIKPEMIGHYLGEFSITYKPVKHGRPGIGATHSSRFIPLK

SEQ ID NO: 1415 - protein, 153 aa, Methanococcus jannaschii
MARMHARKRGRSGSKRPVRKEVPEWVQYTPEQVEQLVVELAKKGYQSAQIGLILRDTYGIPDVKLITGKKISKIMKEHGLYPKVPEDLLNLMRRAVNLRKHLEQHPKDLHSKRGLQLIESKIRRLVKYYKSKGVLPADWRYTPETARLLVEQA

SEQ ID NO: 1416 - protein, 88 aa, Mycoplasma flocculare
MITKAKKAEIITRFGKSEKNTGDISVQIALLPEDIEKLKLHFEKNKKDKHSMRGFIAKVNKRKKLLNYLKEKNFASYKETIEALNIRK

SEQ ID NO: 1417 - protein, 86 aa, Mycoplasma genitalium
MKIDKEQIIKAHQLHKNDVGSVQVQISILTDQIKKLTDHLLANKKDFISKRGLYTKVSKRKRLLKYLKERNIETYRDLIKNLNLRG

SEQ ID NO: 1418 - protein, 88 aa, Mycoplasma hyopneumoniae
MISKARKQEIILKFGKNPKNTGNTSVQIALLTEDIERLKLHFLKNKKDKHSMRGFIAKVNKRKKLLNYLRINSFDTYKETIEALNIRK

SEQ ID NO: 1419 - protein, 89 aa, Mycobacterium leprae
MALTSEQKKEILSSYGLHATDTGSPEAQIALLTKRIADLTEHLKVHKHDHHSRRGLLLLVGRRRRLIKYLSLIDVQRYRSLIERLGLRR

SEQ ID NO: 1420 - protein, 86 aa, Mycoplasma pneumoniae
MQIDKNGIIKSAQLHDKDVGSIQVQVSLLTSQIKQLTDHLLANKKDFISKRGLYAKVSKRKRLLKYLKHNDLEAYRNLVKTLNLRG

SEQ ID NO: 1421 - protein, 89 aa, Mycobacterium tuberculosis
MALTAEQKKEILRSYGLHETDTGSPEAQIALLTKRIADLTEHLKVHKHDHHSRRGLLLLVGRRRRLIKYISQIDVERYRSLIERLGLRR

SEQ ID NO: 1422 - protein, 152 aa, Oryza sativa
MADVEVETEVAAGAQPKKRTFRKYSYRGVDLELLDMSTDDLVQLFPARARRRFQRGLKRKPMAHQEAAQGEKGCPCWREAEPVRTHLRNMIIVPEMIGSIVGVYNGKTFNQVEIKPEMIGHYLAEFSISYKPVKHGRPGIGATHSSRFIPLK

SEQ ID NO: 1423 - protein, 88 aa, Photorhabdus luminescens
SLSTEAKAQIIAEFGRDANDSGSSEVQVALLTAQINHLQGHFSEHKKDHHSRRGLLRMVSQRRKLLDYLKRKNVTSYTALIGRLGLRR

SEQ ID NO: 1424 - protein, 152 aa, Podospora anserina
MADEYNAEEAAELKKKRTFRKFSYRGVDLDALLDLTSDELRDVVHARARRKINRGLKRRPMGLIKKLRKAKQEAKPNEKPDLVKTHLRDMIVVPEMIGSVVGIYSGKEFNQVEIKPEMVGHYLGEFSISYKPVKHGRPGIGATHSSRFIPLK

SEQ ID NO: 1425 - protein, 89 aa, Synechocystis sp. (strain PCC 6803)
MSLTQIRKQELMTEYQAHETDTGSADLQVAFLTERITQLTGHLKANPKDHASRRGLLKMIGRRKRLLSFINAREPERYQALIKRLGIRR

SEQ ID NO: 1426 - protein, 88 aa, Thermus aquaticus (subsp. thermophilus)
PITKEEKQKVIQEFARFPGDTGSTEVQVALLTLRINRLSEHLKVHKKDHHSHRGLLMMVGQRRRLLRYLQREDPERYRALIEKLGIRG

SEQ ID NO: 1427 - protein, 144 aa, Xenopus laevis
AEVEQKKKRTFKKFTYRGVDLDQLLDMSYEQVMQLYCARQRRRLNRGLRRKQNSLLKRLRKAKKEAPPMEKPEVIKTHLRDMIILPEMVGSMVGVYNGKAFNQVEIKPEMIGHYLGEFSITYKPVKHGRPGIGATHSSRFIPLK

SEQ ID NO: 1428 - protein, 145 aa, Xiphophorus maculatus
MADTEIKKKRTFRKFTYRGVDLDQLLDMSYEQLMQLYCARQRRRLNRGLRRKHQSLLKRLPKAKKEAPPMEKPEVVKTHLRDMVILPEMVGSMVGVYNGKTFNQVEIKPEMCGHYLGEFSITYKPVKHGRPGIGATHSSRFIPLK

SEQ ID NO: 1429 - protein, 142 aa, Saccharomyces cerevisiae
MSQAVNAKKRVFKTHSYRGVDLEKLLEMSTEDFVKLAPARVRRRFARGMTSKPAGFMKKLRAAKLAAPENEKPAPVRTHMRNMIIVPEMIGSVVGIYNGKAFNQVEIRPEMLGHYLGEFSITYTPVRHGRAGATTSRFIPLK

SEQ ID NO: 1430 - protein, 88 aa, Yersinia enterocolitica
SLSVEAKAKIVADFGRDANDTGSSEVQVALLTAQINHLQGHFSEHKKDHHSRRGLLRMVSTRRKLLDYLKRKDVASYVSLIERLGLRR

SEQ ID NO: 1431 - protein, 146 aa, Arabidopsis thaliana
MATQPATESVQCFGRKKTAVAVTHCKRGSGLIKLNGCPIELFQPEILRFKIFEPVLLLGKHRFAGVNMRIRVNGGGHTSQVYAIRQSIAKALVAYYQKYVDEQSKKEIKDILVRYDRTLLVADPRRCEPKKFGGRGARSRYQKSYR

SEQ ID NO: 1432 - protein, 89 aa, Bacillus subtilis
AVKIRLKRMGAKKSPFYRIVVADSRSPRDGRFIETVGTYNPVAKPAEVKIDEELALKWLQTGAKPSDTVRNLFSSQGIMEKFHNAKQGK

SEQ ID NO: 1433 - protein, 144 aa, Caenorhabditis elegans
MTSTVQSVQTFGRKKTATAVAHCKKGQGLIKVNGRPLEFLEPQILRIKLQEPLLLVGKERFQDVDIRIRVSGGGHVAQIYAVRQALAKALVAYYHKYVDEQSKRELKNIFAAYDKSLLVADPRRRESKKFGGPGARARYQKSYR

SEQ ID NO: 1434 - protein, 82 aa, Escherichia coli [sequence omitted]

SEQ ID NO: 1435 - protein, 145 aa, Fritillaria agrestis
MATPATESVQCFGRKKTAVAVTHCKRGRGLIKVNGSPIELVKPEILRYKAFEPILLLGRHRFVGVDMRIRVRGGGKTSQIYAIRQSIAKALVAYYQKYVDEQAKKEVKDILMRYDRTLLVADPRRCEPKKFGGRGARSRFQKSYR

SEQ ID NO: 1436 - protein, 145 aa, Gossypium hirsutum
MAEKAIESVQCFGRKKTAVAVTHCKRGRGLIKINGCPIELVEPEILRFKAVEPILLLGRQRFTGVDMRIRVKGGGHTSQIYAIRQSIAKALVAFYQKYVDEQSKKEIKDILVGYDRTLLVADPRRCEPKKFGGRGARARFQKSYR

SEQ ID NO: 1437 - protein, 82 aa, Haemophilus influenzae
MVTIRLSRGGAKKRPFYQIVVADSRSPRDGRFIERVGFFNPIAQGNAERLRINLERVNHWVAQGASLSDRVASLVKEAQKAA

SEQ ID NO: 1438 - protein, 76 aa, Helicobacter pylori
MTVIRLTRIGRKKKPFYRVVVTDSRKRRDGGWIESIGYYNPLSEPKDIKIDKERLNYWKGVGAKMSERVEKLSQKA

SEQ ID NO: 1439 - protein, 145 aa, Homo sapiens [sequence omitted]

SEQ ID NO: 1440 - protein, 145 aa, Lupinus polyphyllus
MATDQHSNKSNVSAARKPLSPSPTASAAGLIKINGSPIELVEPEILRFKAFEPILLLGKSRFAGVDMRIRVKGGGHTSQIYAIRQSIAKALVAFYQKYVDEQSKKEIKDILVRYDRTLLVADPRRCEPKKFGGRGARARFQKSYR

SEQ ID NO: 1441 - protein, 144 aa, Mus musculus
PSKGPLQSVQVFGRKKTLAVAHCKRGNGLIKVNGRPLEMIEPRALQYKLLEPVLLLGKERFAGVDIRVRVKGGGHVAQIYAIRQSISKALVAYYQKYVDEASKKEIKDILIQYDRTLLVADPRRCESKKFGGPGARARYQKSYR

SEQ ID NO: 1442 - protein, 89 aa, Mycoplasma genitalium
MRMGRVHYPLYRIVAVDSRVKRNGKYIALIGHLNPALKENKCKLDETVALDWLNKGAIPTDTVRSLFSESGLWKKFIESKNKKETSPKK

SEQ ID NO: 1443 - protein, 160 aa, Mycobacterium leprae
MAVKIKLTRLGKIRNPQYRVIVADARTRRDGRSIEVIGRYHPKEEPSLIDINSERTQYWLSVGAKPTEPVLKLLKITGDWQKFKGLPGAEGRLKVAPPKPSKLELFNAALAVADGGPTTEATRPKKKVSAKKAAKAVESDAEGAKATKAYALAEGDEQSE

SEQ ID NO: 1444 - protein, 88 aa, Mycoplasma pneumoniae
MRMGRVHYPTYRIVAVDSRVKRDGKYIALIGHLNPALKENKCKIDEAVALEWLNKGAKPTDTVRSLFSQTGLWKKFVESKKKPVAKSK

SEQ ID NO: 1445 - protein, 162 aa, Mycobacterium tuberculosis
MAVKIKLTRLGKIRNPQYRVAVADARTRRDGRAIEVIGRYHPKEEPSLIEINSERAQYWLSVGAQPTEPVLKLLKITGDWQKFKGLPGAQGRLKVAAPKPSKLEVFNAALAAADGGPTTEATKPKKKSPAKKAAKAAEPAPQPEQPDTPALGGEQAELTAES

SEQ ID NO: 1446 - protein, 149 aa, Oryza sativa
MAAALTRPPPGTVQCFGRKKAAVAVSYCKPGRGLIKVNGVPIELIRPEMLRLKAFEPILLAGRSRFKDIDMRIRVRGGGKTSQIYAIRQAIAKALVAYYQKYVDEASKKEVKDIFARYDRTLLVADPRRCEPKKFGGRRARARFQKSYR

SEQ ID NO: 1447 - protein, 82 aa, Salmonella typhimurium
MVTIRLARHGAKKRPFYQVVVTDSRNARNGRFIERVGFFNPIASEKEEGTRLDLDRIAHWVGQGATISDRVAALIKEVKKAA

SEQ ID NO: 1448 - protein, 82 aa, Synechocystis sp. (strain PCC 6803)
MIKLRLKRFGKKREVSYRIVAMHSTTRRDGRPLEELGFYNPRTDETRLDVPAIVKRLKEGAQPTDTVRSILTKAQVFEQLKA

SEQ ID NO: 1449 - protein, 84 aa, Actinobacillus actinomycetemcomitans
TDKIRSVQGRVVSDKMEKSFVVAIERKVKHPLYGKFIRRTTKLHVHDENNEAKLGDLVEVRECRPISKTKSWTLVRVVEKAVIA

SEQ ID NO: 1450 - protein, 84 aa, Acyrthosiphon kondoi symbiotic bacterium
MTDVIRTLQGRVVSHKMEKSIVVAIERTVKHPIYGKFIKRTTKLHVHDENNECGIGDVVEIRECRPLSKTKSWTLVRVVDKAIL

SEQ ID NO: 1451 - protein, 86 aa, Bacillus stearothermophilus
SERNQRKVYVGRVVSDKMDKTITVLVETYKKHPLYGKRVKYSKKYKAHDEHNEAKVGDIVKIMETRPLSATKRFRLVEIVEKAVVL

SEQ ID NO: 1452 - protein, 86 aa, Bacillus subtilis
SERNQRKVYQGRVVSDKMDKTITVVVETYKKHTLYGKRVKYSKKFKAHDENNQAKIGDIVKIMETRPLSATKRFRLVEVVEEAVII

SEQ ID NO: 1453 - protein, 125 aa, Caenorhabditis elegans
MSRVRTKTVKKASRVLIEKYYTRMTNDFHNNKRVCDEVAIIGSKPLRNKIAGYITHLMRRIERGPVRGISIKLQEEERERRDNYMPEISTVDPSQLTSIKVDTDTSDMLKAAVSFQKIKIQLWES

SEQ ID NO: 1454 - protein, 83 aa, Chlamydia trachomatis
MASDVRGRRKTKIGVVVSSKMEKTVVVRVERVYSHPQYAKVVRDSSKYYAHNELDVKEGDTVRIQETRPLSKTKRWRVVGRVN

SEQ ID NO: 1455 - protein, 134 aa, Cricetulus griseus
GRVRTKTVKKAARVIIEKYYTRLGNDFHTNKRVCEEIAIIPSKKLRNKIAGYVTHLMKRIQRGPVRGISIKLQEEERERRDNYVPEVSALDQEIIEVDPDTKEMLKLLDFGSLSNLQVTQPTVGMNFKTPRGAV

SEQ ID NO: 1456 - protein, 134 aa, Dictyostelium discoideum
GRVRTKTIKRASKLLIEKHYPRLTNDFDTNKRTCDKLAKIPSKRLRNKIAGFCTHLMRRIANGPVRGISYKLQEEEREKRDNYVPQESAIKTNEVKIDRDVEEMLKSTLEFPTIPQIHVVDQKRYNKNTKKSNK

SEQ ID NO: 1457 - protein, 130 aa, Drosophila melanogaster
GRVRTKTVKKAAKVIIEKYYTRLTLDFHTNKRICEEVAIIPTKPLRNKIAGYVTHLMGRLRHSQVRGISIKLQEEERERRDNYVPAVSALEQDIIEVDADTKEMLKLLDFHNIRGLQLTQPNTNNFGRRN

SEQ ID NO: 1458 - protein, 83 aa, Escherichia coli
TDKIRTLQGRVVSDKMEKSIVVAIERFVKHPIYGKFIKRTTKLHVHDENNECGIGDVVEIRECRPLSKTKSWTLVRVVEKAVL

SEQ ID NO: 1459 - protein, 84 aa, Haemophilus influenzae
TDKIRSVQGKVVSDKMEKSFVVAIERKVKHPLYGKFIRRTTKLHVHDENNEAKVGDTVEIRECRPLSKTKSWTLVRVVEKAVIA

SEQ ID NO: 1460 - protein, 86 aa, Helicobacter pylori
MNTKEPHKRLVQGKVISKFAEKSAVILVERKVVHEKYRKIVKKFKKYTIHDENNQVKVGDFVSAIECRPLSKTKSFTLKEILVVGV

SEQ ID NO: 1461 - protein, 134 aa, Homo sapiens
GRVRTKTVKKAARVIIEKYYTRLGNDFHTNKRVCEEIAIIPSKKLRNKIAGYVTHLMKRIQRGPVRGISIKLQEEERERRDNYVPEVSALDQEIIEVDPDTKEMLKLLDFGSLSNLQVTQPTVGMNFKTPRGPV

SEQ ID NO: 1462 - protein, 117 aa, Methanococcus jannaschii
MAARNIGIQVKAPEVECDDKNCPFHGNLPVRGQSFVGVVVSDKPHKTVIIKREVVKYIKKYERYERRTTKLAAHNPPCIHARVGDIVRVMECRPISKTKAFVVVEKLGRIDEVKGEE

SEQ ID NO: 1463 - protein, 106 aa, Methanobacterium thermoautotrophicum
MVGIDVPEPKSKCSDPNCPFHGDLPLRGQILEGTVVSDKAERTVTVERSFYKFIRKYERYEKRKSKIKAHKPDCIDVRVGDTVKIAECRPLSKTKNFVVVEVKGEE

SEQ ID NO: 1464 - protein, 109 aa, Methanococcus vannielii
MSNIGIDVKAPENVCEDVNCPFHGTLSVRGQIFEGVVSGDKGHNTIVIKREVTGYISKYERYEKRTTSLVAHNPPCINAKTGDVVKVMECRPVSKTKSFVVIEKTENLE

SEQ ID NO: 1465 - protein, 136 aa, Mycobacterium bovis
MAEAKTGAKAAPRVAKAAKAAPKKAAPNDAEAIGAANAANVKGPKHTPRTPKPRGRRKTRIGYVVSDKMQKTIVVELEDRMRHPLYGKIIRTTKKVKAHDEDSVAGIGDRVSLMETRPLSATKRWRLVEILEKAKP

SEQ ID NO: 1466 - protein, 85 aa, Mycoplasma capricolum
MQRNSRRVLIGKVVSDKMDKTITVLVETYKNHPIYKKRVKYSKKYKAHDENQVAQMGDKVEIMETRPLSKTKNFRLVRVIEKATL

SEQ ID NO: 1467 - protein, 85 aa, Mycoplasma genitalium
MKRNQRKQLIGTVVSTKNAKTATVKVTSRFKHPLYHKSVIRHKKYHVHNFGELVANDGDRVQIIETRPLSALKRWRIVKIIERAK

SEQ ID NO: 1468 - protein, 126 aa, Mycobacterium leprae
MAAEAKTSAKAAPSATTAAPKGGAVKGGVSKDKGPKHTPSIPKVRGGRKMRIGYVVSDKMQKTIVVELEDRMRHPLYGKIIRTTKKVKAHDENSVAGIGDRVSLMETRPLSATKRWRLVEILEKAK

SEQ ID NO: 1469 - protein, 85 aa, Mycoplasma pneumoniae
MKRNQRKVLIGIVKSTKNAKTATVQVESRFKHPLYHKSVVRHKKYQAHNEGEVLAKDGDKVQIVETRPLSATKRFRIAKIIERAK

SEQ ID NO: 1470 - protein, 146 aa, Neurospora crassa
MGRVRTKTVKKSAKVIIERYYPKLTLDFETNKRICDEIAIIASKRLRNKIAGYTTHLMKRIQRGPVRGISFKLQEEERERKDQYVPEVSALDFTQNSESGQLDVDTETKDLLKHLGFDSIPVNVIPVTQAQPVERGRRFGDRPRRD

SEQ ID NO: 1471 - protein, 134 aa, Rattus norvegicus
GRVRTKTVKKAARVIIEKYYTRLGNDFHTNKRVCKEIAIIPSKNLRNKIAGYVTHLMKRIQRGPVRGISIKLQEEERERRDNYVPEVSALDQEIIEVDPDTKEMLKLLDFGSLSNLQVTQPTVGMNFKTPRGAV

SEQ ID NO: 1472 - protein, 85 aa, Spiroplasma citri
MERNSRKVLQGRVISDNLKKTITVLVETYKNHPLYKKRVKYSKKYLAHDEQNQAHIGDKVSIMETRPLSKTKHFRLIEVIEKAIG

SEQ ID NO: 1473 - protein, 82 aa, Synechococcus sp. (strain PCC 6301)
MAVKERVGVVVSDKMDKTVVVAIEDRTAHPKYGKIVVRTKRYKAHDEDNRAKTGDRVRIQETRPLSRTKRWTVAEILESVGA

SEQ ID NO: 1474 - protein, 81 aa, Synechocystis sp. (strain PCC 6803)
MAIKERVGIVVSNKMDKTVVVAVESRSPHPKYGKIVVKTKKFKAHDEENQCQEGDKVRIQETRPLSKTKRWQVINIMSHSS

SEQ ID NO: 1475 - protein, 107 aa, Thermotoga maritima
MPRKRLTGIVVSDKMDKTVVVAVEKLVQHPLYKKYVKRTKKYHAHDERNECKIGDVVEIEETRPLSKAKRWRVVRIIQRFEPERVVKEKEDIQEEIEAVEGKGGVES

SEQ ID NO: 1476 - protein, 104 aa, Thermus aquaticus (subsp. thermophilus)
PKKVLTGVVVSDKMQKTVTVLVERQFPHPLYGKVIKRSKKYLAHDPEERYKVGDVVEIIEARPISKRKRFRVLRLVEEGRLDLVEKYLVRRQNYASLSKRGGKA

SEQ ID NO: 1477 - protein, 152 aa, Arabidopsis thaliana [sequence omitted]

SEQ ID NO: 1478 - protein, 77 aa, Bacillus stearothermophilus
AGRKGGRGKRRKVCYFTANNITHIDYKDVDLLKKFISERGKILPRRVTGTSAKYQRKLTVAIKRARQMALLPYVADE

SEQ ID NO: 1479 - protein, 78 aa, Bacillus subtilis
AGGRRGGRAKRRKVCYFTSNGITHIDYKDVDLLKKFVSERGKILPRRVTGTNAKYQRKLTAAIKRARQMALLPYVSGE

SEQ ID NO: 1480 - protein, 153 aa, Chlamydomonas reinhardtii
MGSLVQGDDFQHILRLLNTNVDGKNKIMYAMTAIRGIGRRFSNLVCKKAEVDLRKAAGECSADELERMMGIVANPRAYKIPDWFLNRQKDHKTGRFSQLTSSQLDTVMRDDLERLKKIRGHRGLRHYWGLRVRGQHTKTTGRAGKTVGVAKKK

SEQ ID NO: 1481 - protein, 77 aa, Chlamydia trachomatis
MNRPVHNEHRRKRFAKKCPFVSAGWKTIDYKDVVTLKRFITERGKILPRRITGVSSRFQALLAQAVKRARHVGLLLS

SEQ ID NO: 1482 - protein, 152 aa, Drosophila melanogaster [sequence omitted]

SEQ ID NO: 1483 - protein, 74 aa, Escherichia coli
ARYFRRRKFCRFTAEGVQEIDYKDIATLKNYITESGKIVPSRITGTRAKYQRQLARAIKRARYLSLLPYTDRHQ

SEQ ID NO: 1484 - protein, 155 aa, Entamoeba histolytica
MATVTSESEFQHMLRVCNTNLDGRRKVPYALTGIKGCGRRYAYLVCKRAGIDVNKRAGLMTPAEIEKIVDILTTQLNYKIPVWFLNRQKDNKDGKDSQLIANAVETRLREDIEALKKMRAHRGLRHYWGLRVRGQNTKTTGRRGRTVGVSRTKRA

SEQ ID NO: 1485 - protein, 74 aa, Haemophilus influenzae
ARYFRRRKFCRFTAENVVEIDYKDIATLKNYISESGKIVPSRITGTRAKYQRQLARAIKRARYLALLPYTDNHQ

SEQ ID NO: 1486 - protein, 85 aa, Helicobacter pylori
MERKRYSKRYCKYTEAKISFIDYKDLDMLKHTLSERYKIMPRRLTGNSKKWQERVEVAIKRARHMALIPYIVDRKKVVDSPFKQH

SEQ ID NO: 1487 - protein, 152 aa, Homo sapiens [sequence omitted]

SEQ ID NO: 1488 - protein, 105 aa, Mycoplasma genitalium
MMINKEQDLNQLETNQEQSVEQNQTDEKRKPKPNFKRAKKYCRFCAIGQLRIDFIDDLEAIKRFLSPYAKINPRRITGNCNMHQRHVANALKRARYLALVPFIKD

SEQ ID NO: 1489 - protein, 104 aa, Mycoplasma pneumoniae
MMNNEHDNFQKEVETTTETTFNREEGKRMVRPLFKRSKKYCRFCAIGQLRIDLIDDLEALKRFLSPYAKINPRRITGNCQMHQRHVAKALKRARYLALVPFVKD

SEQ ID NO: 1490 - protein, 84 aa, Mycobacterium tuberculosis
MAKSSKRRPAPEKPVKTRKCVFCAKKDQAIDYKDTALLRTYISERGKIRARRVTGNCVQHQRDIALAVKNAREVALLPFTSSVR

SEQ ID NO: 1491 - protein, 76 aa, Neisseria gonorrhoeae
MARQSFKRRKFCRFTAEKIQEVDYKQVDLLKDFISENGKIIPARITGTKAFYQRQLAVAVKRARFLALLPYTDQHK

SEQ ID NO: 1492 - protein, 71 aa, Synechocystis sp. (strain PCC 6803)
MNYYRKRLSPLPPNQPIDYKDTELLRKFITERGKILPRRITGLTAKQQRDLTTAVKRSRLVALLPFVNKEI

SEQ ID NO: 1493 - protein, 146 aa, Saccharomyces cerevisiae
MSLVVQEQGSFQHILRLLNTNVDGNIKIVYALTTIKGVGRRYSNLVCKKADVDLHKRAGELTQEELERIVQIMQNPTHYKIPAWFLNRQNDITDGKDYHTLANNVESKLRDDLERLKKIRAHRGIRHFWGLRVRGQHTKTTGRRRA

SEQ ID NO: 1494 - protein, 91 aa, Bacillus stearothermophilus
GRSLKKGPFCDEHLMKKIEKLNETGQKQVIKTWSRRSTIFPQFVGHTIAVYDGRRHVPVYITEDMVGHKLGEFAPTATFRGHAGDDKKTKR

SEQ ID NO: 1495 - protein, 91 aa, Bacillus subtilis
ARSLKKGPFVDGHLMTKIEKLNETDKKQVVKTWSRRSTIFPQFIGHTIAVYDGRKHVPVFISEDMVGHKLGEFAPTRTYKGHASDDKKTRR

SEQ ID NO: 1496 - protein, 92 aa, Borrelia burgdorferi
MARSIKKGPFIEKSLYQKVLSSFGSEKRVVIKTYSRSSTIIPEMVSLTISVYNAKTFIPIYITEDLVGHKLGEFSPTRIFRGHAKSDKKGRK

SEQ ID NO: 1497 - protein, 155 aa, Drosophila melanogaster
PGVTVKDIDQHAVTKAVAVFLKKTGKLKVPDQMDIIKTAKFKELAPYDPDWFYVRCASILRHLYHRSPAGVGSITKIYGGRKRNGVHPSHFCRAADGAARKALQALEHARLVEKHPDGGRKLSSIGQRDLDRIANQIVFKQRDAAKQTGPIVISK

SEQ ID NO: 1498 - protein, 91 aa, Escherichia coli
PRSLKKGPFIDLHLLKKVEKAVESGDKKPLRTWSRRSTIFPNMIGLTIAVHNGRQHVPVFVTDEMVGHKLGEFAPTRTYRGHAADKKAKKK

SEQ ID NO: 1499 - protein, 148 aa, Aspergillus nidulans
MGGVTVRDVDAQKFIVAYAAFLKRQGKLPIPGWVDTVKTSASNELPPQDADWYYVRAAAVARHIYLRKTVGVGRLRKVHGSTKNRGSRPAHHVDASGAVDRKVLQSLEKIGVLEQDEEKGGRRITQSGQRDLDRIAKTTVDEEEEDDE

SEQ ID NO: 1500 - protein, 148 aa, Entamoeba histolytica
MHHFSNIKDVVAIDFIKAYAEHLKKSGKLEIPEWVDTVKTGMCKELAPLNPDWIYIRAAAIARKVYLNNGIGVMALRRAYGDQYNKHYYPSHRTLGSGKVNRYILQQLEKMGIVGKIQSGRSLTKEGRKDMDKIASKFIRNMKPKLLQ

SEQ ID NO: 1501 - protein, 90 aa, Haemophilus influenzae
PRSLKKGPFLDLHLLKKVEKAVESGDKKPIKTWSRRSMIIPSMIGLTIAVHNGRQHVPVYVSDEMIGHKLGEFAPTRTYRGHAADKKAKK

SEQ ID NO: 1502 - protein, 93 aa, Helicobacter pylori
MSRSIKKGPFIDDHLMKKTLKAKEGKDNRPIKTWSRRSTILPEMIGFTYNVHNGRVFIPVYITENHVGYKLGEFAPTRTFKGHKGSVQKKIGK

SEQ ID NO: 1503 - protein, 144 aa, Homo sapiens
PGVTVKDVNQQEFVRALAAFLKKSGKLKVPEWVDTVKLAKHKELAPYDENWFYTRAASTARHLYLRGGAGVGSMTKIYGGRQRNGVMPSHFSRGSKSVARRVLQALEGLKMVEKDQDGGRKLTPQGQRDLDRIAGQVAAANKKH

SEQ ID NO: 1504 - protein, 152 aa, Methanococcus jannaschii
MASARRRRIKKKKQVISKKIEFRYRGYTLEELQQMPLREFAKLLPARQRRTLLRGLTPQQKKLAMKIKKARRLLNKGKEPRIIRTHCRDFVITPDMVGLTFGVYNGKEFVEVKVTPEMIGHYLGEFSLTRKPVQHGAPGMGATRSSMFVPIK

SEQ ID NO: 1505 - protein, 136 aa, Methanobacterium thermoautotrophicum
MARKEFRYRGYTLEELQEMPLDDVIKLFPSRQRRSLKRGFLPRQKKVLEKIRKIKKEGKTEGRPPVIRTHCRDMIVLPEMVGMTFGIHNGKEFVEVKIQPEMIGCYFGEFAPTRKKVEHGDPGMGATRFSMFVPLK

SEQ ID NO: 1506 - protein, 149 aa, Mya arenaria
MGISVKDVSSHEFTRAFAAFLKKSGKMKVPEWTDFVKTGMFKELSPYEPDWYFIRAASICRHLYIRSPAGIGSFEKIYGGRRRRGTAPSHFCKANGSISRRLLQSLEGLKIVEKDPNGGRRLTSQGRRDLDRIAAQIAPKRAPSAPKTV

SEQ ID NO: 1507 - protein, 93 aa, Mycobacterium bovis
MPRSLKKGPFVDEHLLKKVDVQNEKNTKQVIKTWSRRSTIIPDFIGHTFAVHDGRKHVPVFVTESMVGHKLGEFAPTRRFKGHIKDDRKSKRR

SEQ ID NO: 1508 - protein, 88 aa, Mycoplasma capricolum
MARSLKKGPFVDENLFKKVTSAKDGEVIKTWSRRSTIFPEFIGKTFGVYNGKEFIPVYITEDMVGNKLGEFAPTRKFGGHGDDKGKKK

SEQ ID NO: 1509 - protein, 87 aa, Mycoplasma genitalium
MSRSSKKGAFVDAHLLKKVIEMNKQAKKKPIKTWSRRSTIFPEFVGNTFSVHNGKTFINVYVTDDMVGHKLGEFSPTRNFKQHTANR

SEQ ID NO: 1510 - protein, 93 aa, Mycobacterium leprae
MPRSLKKGPFVDDHLLKKVDVQNEKNTKQVIKTWSRRSTIIPDFIGHTFAVHDGRKHVPVFVTEAMVGHKLGEFAPTRTFKGHIKDDRKAKRR

SEQ ID NO: 1511 - protein, 87 aa, Mycoplasma pneumoniae
MSRSAKKGAFVDAHLLKKVIDMNKQEKKRPIKTWSRRSTIFPEFVGNTFAVHNGKTFINVYVTDDMVGHKLGEFSPTRNFKQHTANR

SEQ ID NO: 1512 - protein, 146 aa, Oryza sativa
MADSTARTVKDVNPHEFVKAYSAHLKRSGKMELPEWVDIVKTARFKELPPYDPDWYYTRAASIARKIYLRQGIGVGGFQKIYGGRQRNGSRPPHFCKSSGAISRNILQQLQKMGIIDVDPKGGRLITSQGRRDLDQVAGRVDVTIA

SEQ ID NO: 1513 - protein, 144 aa, Rattus norvegicus
PGVTVKDVNQQEFVRALAAFLKKSGKLKVPEWVDTVKLAKHKELAPYDENWFYTRAASTARHLYLRGGAGVGSMTKIYGGRQRNGVRPSHFSRGSKSVARRVLQALEGLKMVEKDQDGGRKLTPQGQRDLDRIAGQVAAANKKH

SEQ ID NO: 1514 - protein, 91 aa, Synechococcus sp. (strain PCC 6301)
MARSLKKGPFVADHLLRKVEKLNAKGDKQVIKTWSRASTILPQMIGHTIAVHNGRQHVPVYVTEQMVGHKLGEFAPTRTFRGHTKDKKAGR

SEQ ID NO: 1515 - protein, 92 aa, Synechocystis sp. (strain PCC 6803)
MGRSLKKGPFVAASLLRKIDKLNDKGDKQVVKTWSRASTILPQMVGHTIAVHNGRQHVPVFVSEQMVGHKLGEFAPTRTFRSHSKSDKKARK

SEQ ID NO: 1516 - protein, 95 aa, Thermotoga maritima
MGRSRKKGPYVDRKLLEKIRKLNETGEKKVIKTWSRASMIIPKWVGHGIAVYNGMKHIPVYITENMIGHRLGEFAPTRRFGGHADKKAKKGELKK

SEQ ID NO: 1517 - protein, 130 aa, Agaricus bisporus
MVRISVLNDCLKSICNASRRGKRQVIVRPSSKVVVKFLSVMQRHGYIGEFEIIDDHRGGKIIVQLNGRLNKTGVISPRFNVQHNRIEQWINYLLPSRGIGIIVLTTSSGILDHEEARRKNVGGKLLGYVY

SEQ ID NO: 1518 - protein, 129 aa, Arabidopsis thaliana
VRISVLNDALKSMYNAEKRGKRQVMIRPSSKVIIKFLIVMQKHGYIGEFEYVDDHRSGKIVVELNGRLNKCGVISPRFDVGVKEIEGWTARLLPSRQFGYIVLTTSAGIMDHEEARRKNVGGKVLGFFY

SEQ ID NO: 1519 - protein, 129 aa, Brassica napus
VRISVLNDALKSMFNAEKRGKRQVMIRPSSKVIIKFLIVMQKHGYIGEFEYVDDHRSGKIVVELNGRLNKCGVISPRFDVGVKEIEGWTARLLPSRQFGYIVLTTSAGIMDHEEARRKNVGGKVLGFFY

SEQ ID NO: 1520 - protein, 129 aa, Dictyostelium discoideum
VRISVLNDCLYSIVNAERQGKRQVLVRPSSKVIVKFLEVMMKKRYIGEFEIVDDHRSGKIVIDLIGRINKCGVISPRFDVTLDEIEKWASYLLPSRQFGHIVLTTSLGIMDHNEAKTRHTGGKLLGFFY

SEQ ID NO: 1521 - protein, 129 aa, Drosophila melanogaster
VRMNVLADALKCINNAEKRGKRQVLLRPCSKVIIKFLTVMMKHGYIGEFEIVDDHRSGKIVVNLTGRLNKCGVISPRFDVPINDIEKWTNNLLPSRQFGYVVLTTSGGIMDHEEARRKHLGGKILGFFF

SEQ ID NO: 1522 - protein, 129 aa, Homo sapiens [sequence omitted]

SEQ ID NO: 1523 - protein, 130 aa, Kluyveromyces marxianus
MTRTSVLADALNAINNAEKTGKRQVLIRPSSKVIIKFLQVMQKHGYIGEFEYIDDHRSGKIVVQLNGRLNKCGVISPRFNVKISDVEKWTANLLPARQFGYVILTTSAGIMDHEEAHRKHVSGKILGFVY

SEQ ID NO: 1524 - protein, 129 aa, Paracentrotus lividus
VRMNVLAAALRCICNAEKRCKRQVLIRPCSKVTIKFLMVMIKHGYIGEFEVVDDHRGGKIIVNLNGRLNKCGVISPRFDVPINDMEKWTSNLLPSRQFGYVVLTTSGGIMDHEEARRKHVGGKILGFFF

SEQ ID NO: 1525 - protein, 129 aa, Strongylocentrotus purpuratus
VRMNVLADALRSICNAEKRCKRQVLIRPCSKVTVKFLMVMMKHGYIGEFEIVDDHRGGKIIVNLNGRLNKCGVISPRFDVPINEMEKWTSNLLPSRQFGYVVLTTSGGIMDHEEARRKHVGGKILGFFF

SEQ ID NO: 1526 - protein, 87 aa, Bacillus subtilis
PNIKSAIKRTKTNNERGVHNATIKSAMRTAIKQVEASVANNEADKAKTALTEAAKRIDKAVKTGLVHKNTAARYKSRLAKKVNGLSA

SEQ ID NO: 1527 - protein, 85 aa, Borrelia burgdorferi
MRKNASALKRSRQNLKRKIRNVSVKSELKTIEKRCINMIKAGKKDEAIEFFKFVAKKLDTAARKRIIHKNKAARKKSRLNVLLLK

SEQ ID NO: 1528 - protein, 120 aa, Drosophila melanogaster
MAAAPKDIEKPHVGDSASVHRIRITLTSRNVRSLENVCRDLINGAKNQNLRVKGPVRMPTKTLRITTRKTPCGEGSKTWDRFQMRIHKRIIDLHSPSEIVKKITSINIEPGVEVEVTIAN

SEQ ID NO: 1529 - protein, 86 aa, Escherichia coli [sequence omitted]

SEQ ID NO: 1530 - protein, 86 aa, Haemophilus influenzae
ANIKSAKKRAVQSEKRRQHNASQRSMMRTYIKKVYAQVAAGEKSAAEAAFVEMQKVVDRMASKGLIHANKAANHKSKLAAQIKKLA

SEQ ID NO: 1531 - protein, 89 aa, Helicobacter pylori
MANHKSAEKRIRQTIKRTERNRFYKTKIKNIIKAVREAVAVNDVAKAQERLKIANKELHKFVSKGILKKNTASRKVSRLNASVKKIALA

SEQ ID NO: 1532 - protein, 119 aa, Homo sapiens [sequence omitted]

SEQ ID NO: 1533 - protein, 88 aa, Mycoplasma genitalium
MANIKSNEKRLRQDIKRNLNNKGQKTKLKTNVKKFNKEINLDNLSSVYSQADRLARKGIISLNRAKRLKSKNAVILHKSNTNSTAKKQ

SEQ ID NO: 1534 - protein, 86 aa, Mycobacterium leprae
MTNIKSQQKRNRTNERARLRNKSVKSSLRTAVRAFREAVHAGEKEKAAKLLVSTSRKLDKAASKGVIHKNQAANKKSALARTLNKL

SEQ ID NO: 1535 - protein, 87 aa, Mycoplasma pneumoniae
MANIKSNEKRLRQNIKRNLNNKGQKTKLKTNVKNFHKEINLDNLGNVYSQADRLARKGIISTNRARRLKSRNVAVLNKTQVTAVEGK

SEQ ID NO: 1536 - protein, 117 aa, Oryza sativa
MKSGKIGFESSQEVQHRIRITLSSKSVKNLEKVCGDLVKGAKDKSLKVKGPVRMPTKVLHITTRKSPCGEGTNTWDRFEMRVHKRVIDLVSSADVVKQITSITIEPGVEVEVTISDQ

SEQ ID NO: 1537 - protein, 88 aa, Rhizobium meliloti
MANTTSAKKATRKIARRSAVNKARRSRIRSFVRKVEEAIASGDQALAAAALKAAQPELMRPATKGVMHSNTASRKVSRLAQRVKSLSA

SEQ ID NO: 1538 - protein, 97 aa, Synechocystis sp. (strain PCC 6803)
MANIKSALKRIEIAERNRLQNKSYKSAIKTLMKKTFQSVEAYASDPNPEKLDTINTSMAAAFSKIDKAVKCKVIHKNNAARKKARLAKALQSALPAA

SEQ ID NO: 1539 - protein, 119 aa, Xenopus laevis
MAFKDPGKAPVDQEVAIHRIRITLTSRNVKSLEKVCADLIRGAKEKNLKVKGPVRMPTKTLRITTRKTPCGEGSKTWDRFQMRIHKRLIDLHSPSEIVKQITSISIEPGVEVEVTIADA

SEQ ID NO: 1540 - protein, 62 aa, Anabaena variabilis
MTQIVVGENEHIESALRRFKREVSKAGIFQDMRKHRHFETPIEKSKRKKLALHKQSKRRFRT

SEQ ID NO: 1541 - protein, 55 aa, Bacillus stearothermophilus
SKTIVRKNESIDDALRRFKRAVSKTGTLQEVRKREFYEKPSVRRKKKSEAARKRK

SEQ ID NO: 1542 - protein, 56 aa, Bacillus subtilis
SKTVVRKNESLEDALRRFKRSVSKTGTLQEARKREFYEKPSVKRKKKSEAARKRKF

SEQ ID NO: 1543 - protein, 70 aa, Burkholderia pseudomallai
MTTILLKENEPFEVAIRRFRRAIEKNGLIAELRERQAYEKPTAVRKRKKAAAVKRLHKRLRSQMLPKKLH

SEQ ID NO: 1544 - protein, 88 aa, Caenorhabditis elegans
MQNDAGQTVELYVPRKCSSSNRIIGPKDHASVQIDFVDVDPETGRMIPGKSTRYAICGAIRRMGESDDAILRLAQKDGLVPRDDVKSN

SEQ ID NO: 1545 - protein, 70 aa, Escherichia coli
PVIKVRENEPFDVALRRFKRSCEKAGVLAEVRRREFYEKPTTERKRAKASAVKRHAKKLARENARRTRLY

SEQ ID NO: 1546 - protein, 70 aa, Haemophilus influenzae
PVIKVRENESFDVALRRFKRSCEKAGILAEVRAREFYEKPTTIRKRENATLAKRHAKRNARENARNTRLY

SEQ ID NO: 1547 - protein, 70 aa, Helicobacter pylori
MPGIKVREGDAFDEAYRRFKKQTDRNLVVTECRARRFFESKTEKRKKQKISAKKKVLKRLYMLRRYESRL

SEQ ID NO: 1548 - protein, 83 aa, Homo sapiens
MQNDAGEFVDLYVPRKCSASNRIIGAKDHASIQMNVAEVDKVTGRFNGQFKTYAICGAIRRMGESDDSILRLAKADGIVSKNF

SEQ ID NO: 1549 - protein, 81 aa, Zea mays
MQNEEGKTVDLYVPRKCSATNRIITAKDHASVQINIGHLDANGLYDGHFTTFALSGFVRAQGDADSSLDRLWQKKKAEIKQ

SEQ ID NO: 1550 - protein, 64 aa, Myxococcus xanthus
MPGIRVKEGESIESALKRFKKATEKAGILSEIRKREHYEKPSVKRKKKALAAKKRAVKKARKSF

SEQ ID NO: 1551 - protein, 82 aa, Oryza sativa
MQNEEGQMVDLYVPRKCSATNRIITAKDHASVQINIGHVDENGLYDGRFTTFALSGFIRAQGDADSALDRLWQKRKAEVKQQ

SEQ ID NO: 1552 - protein, 83 aa, Rattus norvegicus
MQNDAGEFVDLYVPRKCSASNRIIAAKDHASIQMNVAEVDRSTGRFNGQFKTYGICGAIRRMGESDDSILRLAKADGIVSKNF

SEQ ID NO: 1553 - protein, 60 aa, Synechocystis sp. (strain PCC 6803)
MTQVVVGQNEPIESALRRFKRQVAKAGIYTDFKKHQFFETPQEKHKRKEATRRRQRSRRR

SEQ ID NO: 1554 - protein, 45 aa, Escherichia coli
MKSNRQARHILGLDHKISNQRKIVTEGDKSSVVNNPTGRKRPAEK

SEQ ID NO: 1555 - protein, 129 aa, Saccharomyces cerevisiae
TRSSVLADALNAINNAEKTGKRQVLIRPSSKVIIKFLQVMQKHGYIGEFEYIDDHRSGKIVVQLNGRLNKCGVISPRFNVKIGDIEKWTANLLPARQFGYVILTTSAGIMDHEEARRKHVSGKILGFVY

SEQ ID NO: 1556 - protein, 143 aa, Brugia malayi
MGKPKGIRAARKLKTHRQAQRWNDKGYKKAHLGTRWKANPFGTASHAKGIVLEKVGVEAKQPNSAIRKCVRVQLIKNGKKITAFVPNDGCLNFIEENDEVLVAGFGRKGHAVGDIPGVRFKIVKVANTSLIALFKGKKERPRS

SEQ ID NO: 1557 - protein, 143 aa, Caenorhabditis elegans
MGKPKGLCTARKLKTHRQEQRWNDKRYKKAHIGTRWKSNPFGGASHAKGIVLEKIGVEAKQPNSAIRKCVRVQLIKNGKKITAFVPNDGCLNFVEENDEVLVSGFGRSGHAVGDIPGVRFKIVKVANTSLIALFKGKKERPRS

SEQ ID NO: 1558 - protein, 142 aa, Fragaria ananassa
MGKTRGMGAARKLKNHRRRQRWADKSYKKSHLGNEWKKPFAGSSHAKGIVLEKIGIEAKQPNSAIRKCARVQLIKNGKKIAAFVPNDGCLNYIEENDEVLIAGFGRKGHAVGDIPGVRFKVVKVSGVSLLALFKEKKEKPRS

SEQ ID NO: 1559 - protein, 123 aa, Haloarcula marismortui
MKDQGRSPRKRTGGRRRPNHKKKKHELGKDTVETQVGEQRLKTVDSRGNTQKVRAVKTDVASIADGAETIEATIENVVENPSNPNYARRNIITKGAILETSEGQARVTSRPGQHGQVNAVLVE

SEQ ID NO: 1560 - protein, 143 aa, Homo sapiens [sequence omitted]

SEQ ID NO: 1561 - protein, 143 aa, Schizosaccharomyces pombe
MGKPAGLNAARKLRNHRREERWADAHYKKRLLGTAYKSSPFGGSSHAKGIVVEKIGVEAKQPNSAIRKCVRVQLIKNGKKVTAFVPHDGCLNFVDENDEVLLSGFGRKGKAKGDIPGVRFKVVKVAGVGLSALFHEKKEKPRA

SEQ ID NO: 1562 - protein, 132 aa, Fugu rubripes
MNDTVTVRTRKFMTNRLLQRKQMVVDVLHPGKATVPKTEIREKLAKMYKTTPDVVFVFGFRTQFGGGKTTGFAMVYDSLDYAKKNEPKHRLARHGLFEKKKTSRKQRKERKNRMKKVRGTKKASVGASKKKD

SEQ ID NO: 1563 - protein, 133 aa, Homo sapiens [sequence omitted]

SEQ ID NO: 1564 - protein, 148 aa, Rhizomucor racemosus
MNDQPWMDSEWMQKMRTKRADAAVTIRTRKFLTNRLLQRKQMVVDVIHPGLANVSKDELRSKIGKMYKADKEVVSVFGFKTHFGGGKTTGFALIYDNVEALKNFEPKHRLVRIGLAEAPKGGRKQRKEKKNREKKFRGVRKSKKPRKE

SEQ ID NO: 1565 - protein, 132 aa, Xenopus laevis
MNDTVTIRTRKFMTNRLLQRKQMVIDVLHPGKATVPKTEIREKLAKMYKTTPDVIFVFGFRTHFGGGKTTGFGMIYDSLDYAKKNEPKHRLAKHGLYEKKKTSRKQRKERKNRMKKVRGTAKANVGAGKKKD

SEQ ID NO: 1566 - protein, 134 aa, Saccharomyces cerevisiae
SDAVTIRTRKVISNPLLARKQFVVDVLHPNRANVSKDELREKLAEVYKAEKDAVSVFGFRTQFGGGKSVGFGLVYNSVAEAKKFEPTYRLVRYGLAEKVEKASRQQRKQKKNRDKKIFGTGKRLAKKVARRNAD

SEQ ID NO: 1567 - protein, 117 aa, Caenorhabditis elegans
MPPKKDPKGGKAPPSKKKEGSGGGKAKKKKWSKGKVRDKLNNMVLFDQATYDKLYKEVITYKLITPSVVSERLKVRASLAKAGLKELQAKGLVKCVVHHHGQVVYTRATKEADVIVE

SEQ ID NO: 1568 - protein, 110 aa, Dictyostelium discoideum
MPPKAAGGKSKQIQASKAAAKGSSGGAGRKKWSKGRSREKLNNAILFDKETYAKLLKEMPTAKVITTAVVSERMKCNGSLARRAIKELLSKGLIKQIIKGHGNGVYTKAQ

SEQ ID NO: 1569 - protein, 125 aa, Homo sapiens [sequence omitted]

SEQ ID NO: 1570 - protein, 108 aa, Lycopersicon esculentum
MAPKKAQAPPPSSKPAKSGGGKQKKKKWSKGKQKEKVNNMVLFDKSTYDKLLSEAPKYKLITPSVLSDRLRISGSLARKAIRDLMARGSIRMVSAHASQQIYTRATNT

SEQ ID NO: 1571 - protein, 131 aa, Arabidopsis thaliana
MTFKRRNGGRNKHNRGHVNPIRCSNCGKCCPKDKAIKRFIVRNIVEQAAIRDVQEASVYEGYTLPKLYAKTQYCVSCAIHSHVVRVRSRTNRRVRTPPPRFTRRKEDTPKPGQPGQAPRPAGPGAAAAPRV

SEQ ID NO: 1572 - protein, 115 aa, Cricetus cricetus
MTKKRRNNGRAKKGRGHVQPIRCTNCARCVPKDKAIKKFVIRNIVEAAAVRDISEASVFDAYVLPKLYVELHYCVSCAIHSKVVRNRSREARKDRTPPPRFRPAGAAPRPPPKPM

SEQ ID NO: 1573 - protein, 114 aa, Drosophila melanogaster
MTKKRRNGGRNKHNRGHVKPVRCTNCARCVPKDKAIKKFVIRNIVEAAAVRDITEASIWDSYVLPKLYAKLHYCVSCAIHSKVVRNRSREARRIRTPPLRSFPKDMARNNQNRK

SEQ ID NO: 1574 - protein, 115 aa, Homo sapiens [sequence omitted]

SEQ ID NO: 1575 - protein, 115 aa, Mus musculus
MTKKRRNNGRAKKGRGNVQPIRCTNCARCVPKDKAIKKFVIRNIVEAAAVRDISEASVFDAYVLPKLYVKLHYCVSCAIHSKVVRNRSREARKDRTPPPRFRPAGAAPRPPPKPM

SEQ ID NO: 1576 - protein, 119 aa, Neurospora crassa
MVKKRKNNGRNKKGRGHVKPIRCSNCSRCTPKDKAIKRFTIRNMVESAAIRDISDASVFAEYTVPKMYLKLQYCVSCAIHGKIVRVRSREARRNRAPPPRVRYNKDGKKVTPTQGAKTA

SEQ ID NO: 1577 - protein, 127 aa, Octopus vulgaris
MTSKRRNNGRGKKGRGHVKYIRCTNCARCVPKDKAIKKFVIRNIVEAAAVRDISDASVYEVYALPKLYAKLLYCVSCAIHSKIVRNRSREARKDRTPPIRFRPMRGEGGQNARPGQANKLFNMSPRK

SEQ ID NO: 1578 - protein, 133 aa, Oryza sativa
MIFKRRNGGRIKHGRGHVKYIRCSNCAKCCPKDKAIKRFQVRNIVEQVAIRDVQEGCVHDGYVLPKLYAKVHHCVSCAIHAHIVRVRSRENRRDRRPPERFRRREDRPQGPRPGGGAPAPGGAAAPAPNVART

SEQ ID NO: 1579 - protein, 115 aa, Rattus norvegicus [sequence omitted]

SEQ ID NO: 1580 - protein, 86 aa, Chlamydomonas reinhardtii
MVLSSDIDLLNPPAELEKTKHKRKRLVQSPNSFFMDVKCQGCFNITTVFSHSQTVVMCGSCSSVLCTPTGWPRRLTEGCSFRRKSD

SEQ ID NO: 1581 - protein, 84 aa, Entamoeba histolytica
MPLIEVDLLNPTAASEAKAHKMKRLVPTPNSYFLEIKCPKCGATTTTFSHAHRQILCQKCGQPLGQPTGGKLKLTQQCKFRIKK

SEQ ID NO: 1582 - protein, 83 aa, Homarus americanus
PLAKDLLHPSPSEEKRKCKLKRLVQHPNSYFMDVKCPGCFKISTVFSHAQTVVACVGCATVLCQPTGGKAKLTDGCSFRKKQN

SEQ ID NO: 1583 - protein, 99 aa, Hordeum vulgare
MVLQNDIDLLNPPAELEKLKHKKKRLVQSPNSFFMDVKCQGCFNITTVFSHSQTVVVCPGCQTVLCQPTGGKARLTEGSPSVARATKPVANWKSKPLLN

SEQ ID NO: 1584 - protein, 83 aa, Homo sapiens
PLAKDLLHPSPEEEKRKHKKKRLVQSPNSYFMDVKCPGCYKITTVFSHAQTVVLCVGCSTVLCQPTGGKARLTEGCSFRRKQH

SEQ ID NO: 1585 - protein, 62 aa, Methanococcus jannaschii
MMELIPQPRTKFLRVQCPECNNEQIVFGSPATVVKCLTCGKVLVEPRGGKGKVKAKILEILG

SEQ ID NO: 1586 - protein, 83 aa, Rattus norvegicus
PLARDLLHPSLEEEKKKHKKKRLVQSPNSYFMDVKCPGCYKITTVFSHAQTVVLCVGCSTVLCQPTGGKARLTEGCSFRRKQH

SEQ ID NO: 1587 - protein, 83 aa, Xenopus laevis
PLAKDLLHPTPEEEKRKHKKKRLVQSPNSYFMDVKCPGCYKITTVFSHAQTVVLCVGCSTVLCQPTGGKARLTEGCSFRRKQH

SEQ ID NO: 1588 - protein, 64 aa, Arabidopsis thaliana [sequence omitted]

SEQ ID NO: 1589 - protein, 69 aa, Homo sapiens [sequence omitted]

SEQ ID NO: 1590 - protein, 65 aa, Zea mays
MDTQVKLAVVVKVMGRTGSRGQVTQVRVKFLDDQNRLIMRNVKGPVCEGDILTLLESEREARRLR

SEQ ID NO: 1591 - protein, 78 aa, Methanococcus jannaschii
MMRMEDEFVYKEAVAAEVIEVIGRTGVTGGIIQVRCKILGGKDTGRVLVRNVKGPVKVGDIIMLRETEREARPLDRRR

SEQ ID NO: 1592 - protein, 68 aa, Schizosaccharomyces pombe
MDSSKVPVKLAKVIKVLGRTGSRGGVTQVRVEFMDDTSRSIIRNVKGPVREDDILVLLESEREARRLR

SEQ ID NO: 1593 - protein, 145 aa, Saccharomyces cerevisiae
MGKGKPRGLNSARKLRVHRRNNRWAENNYKKRLLGTAFKSSPFGGSSHAKGIVLEKLGIESKQPNSAIRKCVRVQLIKNGKKVTAFVPNDGCLNFVDENDEVLLAGFGRKGKAKGDIPGVRFKVVKVSGVSLLALWKEKKEKPRS

SEQ ID NO: 1594 - protein, 55 aa, Homo sapiens
GHQQLYWSHPRKFGQGSRSCRVCSNRHGLIRKYGLNMCRQCFRQYAKDIGFIKLD

SEQ ID NO: 1595 - protein, 60 aa, Arabidopsis thaliana
KVHGSLARAGKVRGRHQKVAKQDKKKKPRGRAHKRLQHNRRFVTAVVGFGKKRGPNSSEK

SEQ ID NO: 1596 - protein, 59 aa, Homo sapiens [sequence omitted]

SEQ ID NO: 1597 - protein, 62 aa, Saccharomyces cerevisiae
AKVHGSLARAGKVKSQTPKVEKTEKPKKPKGRAYKRLLYTRRFVNVTLVNGKRRMNPGPSVQ

SEQ ID NO: 1598 - protein, 108 aa, Saccharomyces cerevisiae
MPPKQQLSKAAKAAAALAGGKKSKKKWSKKSMKDRAQHAVILDQEKYDRILKEVPTYRYVSVSVLVDRLKIGGSLARIALRHLEKEGIIKPISKHSKQAIYTRAAASE

SEQ ID NO: 1599 - protein, 67 aa, Kluyveromyces lactis
MDTKTPVTLAKVIKVLGRTGSRGGVTQVRVEFLEDTTRTIVRNVKGPVREGDILVLMESEREARRLR

SEQ ID NO: 1600 - protein, 67 aa, Kluyveromyces marxianus
MDSKTPVTLAKVIKVLGRTGSRGGVTQVRVEFLEDTTRTIVRNVKGPVREGDILVLMESEREARRLR

SEQ ID NO: 1601 - protein, 67 aa, Saccharomyces cerevisiae
MDSKTPVTLAKVIKVLGRTGSRGGVTQVRVEFLEDTSRTIVRNVKGPVRENDILVLMESEREARRLR

SEQ ID NO: 1602 - protein, 76 aa, Saccharomyces cerevisiae
GKKRKKKVYTTPKKIKHKHKKVKLAVLSYYKVDAEGKVTKLRRECSNPTCGAGVFLANHKDRLYCGKCHSVYKVNA

SEQ ID NO: 1603 - protein, 155 aa, Saccharomyces cerevisiae
STELTVQSERAFQKQPHIFNNPKVKTSKRTKRWYKNAGLGFKTPKTAIEGSYIDKKCPFTGLVSIRGKILTGTVVSTKMHRTIVIRRAYLHYIPKYNRYEKRHKNVPVHVSPAFRVQVGDIVTVGQCRPISKTVRFNVVKVSAAAGKANKQFAKF

SEQ ID NO: 1604 - protein, 160 aa, Sulfolobus acidocaldarius
MGPSHPWIKINLGKEQILIGKYGLRNKKEIWIAQTMIRNFRHQARSLLALPPAERNIREKQLIQKLYRMGILEKDNSTLDDILSLTEENYLERRLQTIVYKKGLARTIYQARQLITHGHIAISGRKVTSPGYVVLRGEEDLIDYYPTSPFKQKIHHHKVR

SEQ ID NO: 1605 - protein, 126 aa, Acyrthosiphon kondoi symbiotic bacterium
MAHIEKQAGELQEKLIAVNRVSKTVKGGRIFSFTALTVVGDGNGRVGFGYGKAREVPAAIQKAMEKARRNMMNVALNSGTLQHPVKGAHTGSRVFMQPASEGTGIIAGGAMMVAAKLGKSVADILG

SEQ ID NO: 1606 - protein, 166 aa, Bacillus stearothermophilus
MRRINPNKLELEERVVAVNRVAKVVKGGRRLRFSALVVVGDKNGHVGFGTGKAQEVPEAIRKAIEDAKKNLIEVPIVGTTIPHEVIGHFGAGEIILKPASEGTGVIAGGPARAVLELAGISDILSKSIGSNTPINMVRATFDGLKQLKRAEDVAKLRGKTVEELLG

SEQ ID NO: 1607 - protein, 166 aa, Bacillus subtilis
MRRIDPSKLELEERLVTVNRVAKVVKGGRRFRFAALVVVGDKNGHVGFGTGKAQEVPEAIRKAVEDAKKNLIEVPMVGTTIPHEIIGRFGAGNILLKPASEGTGVIAGGPVRAVLELAGVADILSKSLGSNTPINMIRATLQGLSELKRAEDVAKLRGKSVEELLG

SEQ ID NO: 1608 - protein, 165 aa, Chlamydia trachomatis
MTLSRNSHKEDQLEEKVLVVNRCCKVVKGGRKFSFSALILVGDRKGRLGFGFAKANELTDAIRKGGDAARKNLVSINSLEGGSIPHEVLVNHDGAELLLKPAKPGTGIVAGSRIRLILEMAGVKDIVAKSLGSNNPMNQVKAAFKALLTLSCKDDIMKRRAVIND

SEQ ID NO: 1609 - protein, 166 aa, Escherichia coli
AHIEKQAGELQEKLIAVNRVSKTVKGGRIFSFTALTVVGDGNGRVGFGYGKAREVPAAIQKAMEKARRNMINVALNNGTLQHPVKGVHTGSRVFMQPASEGTGIIAGGAMRAVLEVAGVHNVLAKAYGSTNPINVVRATIDGLENMNSPEMVAAKRGKSVEEILGK

SEQ ID NO: 1610 - protein, 166 aa, Haemophilus influenzae
MSNIEKQVGELQEKLIAVNRVSKTVKGGRIMSFTALTVVGDGNGRVGFGYGKAREVPAAIQKAMEKARRNMINVALNEGTLQHPVKGVHTGSRVFMQPASEGTGIIAGGAMRAVLEVAGVRNVLSKAYGSTNPINVVRATIDALANMKSPEMVAAKRGKTVDEILG

SEQ ID NO: 1611 - protein, 153 aa, Helicobacter pylori
MTERKGMEEINREEFQEVVVNIGRVTKVVKGGRRFRFNALVVVGNKNGLVGFGLGKAKEVPDAIKKAVDDAFKNLIHVTIKGTTIAHDIEHKYNASRILLKPASEGTGVIAGGSTRPIVELAGIKDILTKSLGSNNPYNVVRATFDALAKIKA

SEQ ID NO: 1612 - protein, 183 aa, Micrococcus luteus
MAPRTTRKDQFLERVVGINRVSKVGRRFSFTALVVVGDGDGTVGVGYGKAKEVPAAIQKAVEEAKKSFFRVPRVGSTIPHLVQGEDAAGVVLLRPASPGTAVIAGGPVRAVLECAGIHDVLSKSMGSVNAINIVRGTVEGLKKLKSPQAVAARRGKALDEIAPHAMLRTMENDRAQKSAKAGA

SEQ ID NO: 1613 - protein, 167 aa, Streptomyces coelicolor
MERVVAINRVAKVVKGGRRFSFTALVVVGDGDGTVGVGYGKAKEVPAAIVKGVEEAKKHFFKVPRIQGTIPHPIQGEKAAGVVLLKPASPGTGVIAGGPVRAVLECAGIHDVLSKSLGSDNQINIVHATVEALKGLQRPEEIAARRGLPLEDVAPAALLRARAGAGA

SEQ ID NO: 1614 - protein, 180 aa, Synechococcus sp. (strain PCC 6301)
MAEEKDKKQSSRRRNNRRTEKESEWQERVVQIRRVTKVVKGGKKLSFRAIVIVGNERGQVGVGVGKASDVIGAVRKGVADGKKHLVNVPLTRDQSIPHPSTGEGGAAQVLIRPAAPGTGVIAGGAVRTVLELAGVKNVLAKRLGSKSPLNNARAALEALSSLRTFQEVAQSRDIPVEQLY

SEQ ID NO: 1615 - protein, 173 aa, Synechocystis sp. (strain PCC 6803)
MAKRRKTSREKKEDTNWQERVIQIRRVSKVVKGGKKLSFRAIVVVGNETGQVGVGVGKAGDVIGAVRKGVADGKKQLIEVPLTKSNSITHITNGVSGGAKVVVRPAAPGTGVIAGGAVRTVLELAGVKNILAKQLGSNNPLNNARAAINALETLRTFSEVAEERGVSVEHLYT

SEQ ID NO: 1616 - protein, 161 aa, Thermus aquaticus (subsp. thermophilus)
PETDFEEKMILIRRTARMQAGGRRFRFGALVVVGDRQGRVGLGFGKAPEVPLAVQKAGYYARRNMVEVPLQNGTIPHEIEVEFGASKIVLKPAAPGTGVIAGAVPRAILELAGVTDILTKELGSRNPINIAYATMEALRQLRTKADVERLRKGEAHAQAQG

SEQ ID NO: 1617 - protein, 142 aa, Helicobacter pylori
MRHYETMFILKPTLVEEEIKSKIEFYKEVITKHHGVIETSLDMGMRNLAYEIKKHKRGYYYVAYFKAEPSMIVELERLYRINEDVLRFIVIKYESKKEVEAWHALVDRANKKPSHAKEKHEKTEHTHSHHTEEAESVGSHSE

SEQ ID NO: 1618 - protein, 96 aa, Mycobacterium tuberculosis
MRPYEIMVILDPTLDERTVAPSLETFLNVVRKDGGKVEKVDIWGKRRLAYEIAKHAEGIYVVIDVKAAPATVSELDRQLSLNESVLRTKVMRTDKH

SEQ ID NO: 1619 - protein, 122 aa, Neisseria gonorrhoeae
MRHYEIVFIVHPDQSEQVPAMVERYKTMITEANGKIHRLEDWGRRQLAYPINKIHKAHYVLMNIETTPEVVGELETAFRFNDAVLRHLTIKTKHAVTEASPMLGGEKAKNLLVGAAEEAAAQ

SEQ ID NO: 1620 - protein, 113 aa, Synechocystis sp. (strain PCC 6803)
MLVNSYELMVILRPDLNEERVSQEVTKYQEFLTNNAAEEVSVKVWGKRRLAYQIRRFNDGIYVLFNFNGEGQQIALIERDMRLNDNVMRFLSIKLTPEKPEKEKKAKAVAVEA

SEQ ID NO: 1621 - protein, 131 aa, Methanococcus jannaschii
MPTAKFVVADPKTGRCYQIEADNTPLVGKKIGEVFDGKIIGLEGYKLQIRGGTDSSGFPMRPDIHGSRKVRVLLSAPPGFKPKRKGERRRKTVRGNTIAPDIVQINVKVVEYGEKSIPELLGLEGGENQEQ

SEQ ID NO: 1622 - protein, 126 aa, Methanobacterium thermoautotrophicum
MAFKVVISDKEKSVQMEVDPSESRGLIGLTIGDEFDGSIIGLSGYKLKITGGSDKNGFPMKKTVPGARRIRSLVSGGVGYKPRRDGERRRKTFRGNTISDDIVQINTVVIEKGEKPLEELLGADEE

SEQ ID NO: 1623 - protein, 130 aa, Sulfolobus solfataricus
MNAMSKASYVKFEVPQDLADKVLEAVRKAKESGKIKKGTNETTKAVERGQAKLVIIAEDVQPEEIVAHLPLLCDEKKIPYVYVSSKKALGEACGLQVATASAAILEPGEAKDLVDEIIKRVNEIKGKTSS

SEQ ID NO: 1624 - protein, 156 aa, Anacystis nidulans
MSRRTSAQKRSVNPDPKFNSRLASMMVARLMDSGKKSLAFRILYSAFDLIQERTGNDPLELFEQAVRNATPLVEVRARRVGGATYQVPMEVRSERGTAMALRWLVQYSRQRPGKSMAIKLANELMDAANETGSSVRKREETDKMAEANKAFAHYRY

SEQ ID NO: 1625 - protein, 155 aa, Bacillus stearothermophilus
PRRGPVAKRDVLPDPIYNSKLVTRLINKIMIDGKKSKAQKILYTAFDIIRERTGKDPMEVFEQALKNVMPVLEVRARRVGGANYQVPVEVRPDRRVSLGLRWLVQYARLRNEKTMEERLANEIMDAANNTGAAVKKREDTHKMAEANKAFAHYRW

SEQ ID NO: 1626 - protein, 155 aa, Bacillus subtilis
PRKGPVAKRDVLPDPIYNSKLVSRLINKMMIDGKKGKPQTILYKSFDIIKERTGNDAMEVFEQALKNIMPVLEVKARRVGGANYQVPVEVRPERRTTLGLRWLVNYARLRGEKTMEERLANEILDAANNTGAAVKKREDTHKMAEANKAFAHYRW

SEQ ID NO: 1627 - protein, 157 aa, Chlamydia trachomatis
MSRRHAAEKKVIPGDPVYGSVVLERFINKVMLHGKKSIARKIVYGALERFAKRLGLENPLEGFEEALENAKPILEVRSRRVGGATYQVPVEVAPDRRSCLAMQWIIKHARSKPGKCMEVGLANELIDCFNKQGATIKKREDTHRMAEANKAFAHYKW

SEQ ID NO: 1628 - protein, 178 aa, Escherichia coli
PRRRVIGQRKILPDPKFGSELLAKFVNILMVDGKKSTAESIVYSALETLAQRSGKSELEAFEVALENVRPTVEVKSRRVGGSTYQVPVEVRPVRRNALAMRWIVEAARKRGDKSMALRLANELSDAAENKGTAVKKREDVHRMAEANKAFAHYRWLSLRSFSHQAGASSKQPALGYLN

SEQ ID NO: 1629 - protein, 157 aa, Eikenella corrodens
MPRRREVPKRDVLPDPKFGSVELTKFMNALMVDGKKSVDERIVYGALEQTAKKVQGKEAIEVFNEAIDNAKPIVEVKSRRVGGANYQVPVEVRPSRRLALAMRWVRDAARKRGEKSMDLRLADELIDAAEGRGGAMKKREEVHRMAEANKAFSHFRF

SEQ ID NO: 1630 - protein, 155 aa, Haemophilus influenzae
PRRRSVEARKILPDPKFGSELLAKFINVIMVDGKKSVAESIVYGALETLAQRTGKEPLEAFEVALENVRPTVEVKSRRVGGSTYQVPVEVRPVRRNALGMRWIVEAARKRGDKSMALRLANELSDASDNKGAAVKKREDVHRMAEANKAFAHYRW

SEQ ID NO: 1631 - protein, 155 aa, Helicobacter pylori
MRRRKAPVREVLGDPVYGNKVVTKFINKMMFDGKKSVAEKIIYKAFNKIEEKSGEKGIEVFEKALERVRPLVEVRSRRVGGATYQVPVEVRASRQQSLSIRWILEATRKRNERMMVDRLANELMDAASDKGAAFKKKEDVHKMAEANKAFAHYRW

SEQ ID NO: 1632 - protein, 158 aa, Leptospira biflexa
MSRRRGKVEPRHIEGDPKYNDKVISKFINCLMVDGKKSVAEAVFYDALEVIAKKTGQDPYQVFQEALENAKPQVEVKSRRVGGVTLPQFQSKFVRERRLALGIRWLIRYSRDRNEKSMKNKLAAEFMEAQKGTGSAIKKKEDIRKMADANKAFSHYRW

SEQ ID NO: 1633 - protein, 156 aa, Micrococcus luteus
PRKGPAPKRPLVVDPVYGSPLVTQLINKVLVDGKKSTAERIVYGALEGARAKNGARSRGHPIKKAMDNIKPALEVRSRRVGGATYQVPVEVKPGRSTALALRWLVGFSKARREKTMTERLMNEILDASNGLGGAVKRREDTHKMAEANKAFAHYRW

SEQ ID NO: 1634 - protein, 156 aa, Mycobacterium bovis
MPRKGPAPKRPLVQRPVYDSQLVTQLVNKVLLKGKKSLAERIVYGALEQARDKTGTDPVITLKRALDNVKPALEVRSLRVGGATYQVPVEVRPDRSTTLALRWLVGYSLQRREKTMIERLANEILDASNGLGASVKRREDTHKMAEANRAFAHYRW

SEQ ID NO: 1635 - protein, 155 aa, Mycoplasma genitalium
MRKNRALKRTVLPDPVFNNTLVTRIINVIMKDGKKGLAQRILYGAFEIIEKRTNQQPLTVFEKAVDNVMPRLELKVRRIAGSNYQVPTEVPPDRRIALALRWIVIFANKRNEKTMLERVANEIIDAFNNTGASVKKKDDTHKMAEANKAFAHMRW

SEQ ID NO: 1636 - protein, 155 aa, Mycobacterium leprae
PRKGPAPKRPLVKHPVYGSQLVTQLVNKILLKGKKSLAERIVYGALEHARDKTGTDPVITLKRALDNVKPALEVRSRRVGGATYQVPVEVRPDRSTTLALRWLVGFSRQRREKTMIERLANEILDASNGLGASVKRREDTHKMAEANRAFAHYRW

SEQ ID NO: 1637 - protein, 155 aa, Mycoplasma pneumoniae
MRKNRAPKRTVLPDPVFNNTLVTRIINVIMEDGKKGLAQRILYGAFDLIEQRTKEKPLTVFERAVGNVMPRLELRVRRIAGSNYQVPTEVPQDRKIALALRWIAMFARKRHEKTMLEKIANEIIDASNNTGAAIKKKDDTHKMAEANKAFAHMRW

SEQ ID NO: 1638 - protein, 155 aa, Mycobacterium smegmatis
PRKGPAPKRPLVNDPVYGSQLVTQLVNKVLLEGKKSLAERIVYGALEQAREKTGTDPVVTLKRALDNVKPALEVRSRRVGGATYQVPVEVRPDRSTTLALRWLVNFSRQRREKTMVERLANEILDASNGLGASVKRREDTHKMAEANRAFAHYRW

SEQ ID NO: 1639 - protein, 160 aa, Rickettsia prowazekii
MSRRHVAEKRIILPDMKYNSILLSRFINNIMKAGKKAVAEKIVYSALNKIEKKHSVDPYQTFNNAMHNVKPHLEVTSVRVGGANYQVPTHVDERRGYALASRWIINAASKRSEKMMIDKLAEELFEASNNRGVAIKKKEDTHKMAEANKAFSHFSPKKMK

SEQ ID NO: 1640 - protein, 155 aa, Salmonella typhimurium
PRRRVIGQRKILPDPKFGSELLAKFVNILMVDGKKSTAESIVYSALETLAQRSGKSELEAFEVALENVRPTVEVKSRRVGGSTYQVPVEVRPVRRNALAMRWIVEAARKRGDKSMALRLANELSDAADNKGTAVKKREDVHRMAEANKAFAHYRW

SEQ ID NO: 1641 - protein, 156 aa, Spirulina platensis
MSRRRVVQKRPVPPDSRYNSRLVSMMVRRIMRHGKKSVAHNIVYDALATIEERTGSDPLELFEKAVRNATPLVEVKARRVGGATYQVPMEVRSERGTTLALRWLIHFSRTRSGRSMASRLASELMDAANETGSAVRKREETHRMAEANKAFAHYRY

SEQ ID NO: 1642 - protein, 156 aa, Streptomyces roseosporus
MPRKGPAPKRPVIIDPVYSSPLVTSLINKILLDGKRSTAERIVYGAMEGLREKTGNDPVITLKRALENVKPSLEVKSRRVGGATYQVPIEVKPGRASTLALRWLVGYSRARREKTMTERLMNELLDASNGLGASVKKREDTHKMAESNKAFAHYRW

SEQ ID NO: 1643 - protein, 156 aa, Synechocystis sp. (strain PCC 6803)
MSRRGNVKKRPVPPDPVYNSTLLSMTIRRVMRSGKKSLASSIVYNALASVGEKTGEDPLEVFEKAIKNLTPLVEVKARRVGGATYQVPMEVRPARGTALALRWLVHFSRARGGRTMESKLANEIMDAANETGAAIKKREETHRMAEANKAFAHYRY

SEQ ID NO: 1644 - protein, 155 aa, Thermus aquaticus (subsp. thermophilus)
ARRRRAEVRQLQPDLVYGDVLVTAFINKIMRDGKKNLAARIFYDACKIIQEKTGQEPLKVFKQAVENVKPRMEVRSRRVGGANYQVPMEVSPRRQQSLALRWLVQAANQRPERRAAVRIAHELMDAAEGKGGAVKKKEDVERMAEANRAYAHYRW

SEQ ID NO: 1645 - protein, 130 aa, Acyrthosiphon kondoi symbiotic bacterium
MSMQDPIADMLTRIRNGQAANKVAVTMPSSKLKVAIANVLKEEGFIEDFKIEGGTKPVLELVLKYFQGNAVVESIQRISRPGLRIYKKKDELPKVMAGLGIAVVSTSKGVMTDRAARQAGLGGEIICYVA

SEQ ID NO: 1646 - protein, 130 aa, Bacillus stearothermophilus
VMTDPIADMLTAIRNANMVRHEKLEVPASKIKREIAEILKREGFIRDYEYIEDNKQGILRIFLKYGPNERVITGLKRISKPGLRVYVKAHEVPRVLNGLGIAILSTSQGVLTDKEARQKGTGGEIIAYVI

SEQ ID NO: 1647 - protein, 131 aa, Bacillus subtilis
VMTDPIADMLTRIRNANMVRHEKLEIPASKLKREIAEILKREGFIRDVEFVEDSKQGIIRVFLKYGQNNERVITGLKRISKPGLRVYAKSNEVPRVLNGLGIAIISTSQGVLTDKEARAKQAGGEVLAYVW

SEQ ID NO: 1648 - protein, 133 aa, Chlamydia trachomatis
MGMTSDSIANLLTRIRNALMAEHLYIDIEHSKMLEAIVRILKQHGFIAHFLVKEENRKRLMRVFLRYGEDRRPVIHALKRVSKPSRRVYVSAAKIPYVFGNMGIAVLSTPQGVLEGSVARAKNVGGELLCLVW

SEQ ID NO: 1649 - protein, 129 aa, Escherichia coli [sequence omitted]

SEQ ID NO: 1650 - protein, 129 aa, Haemophilus influenzae
SMQDPIADMLTRIRNGQAANKVAINMPSSKLKVAIANVLAAEGYIESVKVLEGAKPELEITLKYFQGKPVVESIQRVSRPGLRIYKRKDELPKVMGGLGVAVISTSKGVMTDRAARQAGLGGEIICYVA

SEQ ID NO: 1651 - protein, 131 aa, Helicobacter pylori
MVNDIIADSLTRLRNASMRRLEFTQLYYAKIVVSILEIFKEKGFIKDFNVKDKDKKQSVYVQLAYDEKGHSKISEVKRLSKPGRRVYKQKNELKRFKNGYGVIVVSTSKGVITNEEAYRQNVGGEVLCSIW

SEQ ID NO: 1652 - protein, 130 aa, Methanococcus jannaschii
MSLMDPLANALNHISNCERVGKKVVYIKPASKLIGRVLKVMQDNGYIGEFEFIEDGRAGIFKVELIGKINKCGAIKPRFPVKKFGYEKFEKRYLPARDFGILIVSTTQGVMSHEEAKKRGLGGRLLAYVY

SEQ ID NO: 1653 - protein, 133 aa, Methanobacterium thermoautotrophicum
MFTVTLMDPLANALTNIRNNEIRGNVKCRITPASKLIGRVLRTMQKEGYIGEFEYVDDGRAGKFIVELEGNINHCGVIKPRHAVKKDEFEKFEKRYLPAKNFGIIIVSTPEGIMTHKEAKDRGIGGRLLAYVY

SEQ ID NO: 1654 - protein, 130 aa, Methanococcus vannielii
MSLMDPLANALNHVSNCEGVGKNVAYLKPASKLIGRVLKVMQDQGYIGNFEYIEDGKAGVYKVDLIGQINKCGAVKPRYAVKYQEFEKFEKRYLPAKGFGLLIVSTPKGLMTHDEARTAGVGGRLISYVY

SEQ ID NO: 1655 - protein, 132 aa, Micrococcus luteus
TMTDPVADMLTRLRNANSAYHDTVSMPSSKLKTRVAEILKAEGYIQDWREEEAEVGKKLTIDLKFGPQRERAIAGLRRISKPGLRVYAKSTNLPHVLGGLGIAILSTSSGLLTNQQAAKKAGVGGEVLAYVW

SEQ ID NO: 1656 - protein, 129 aa, Mycoplasma capricolum
MTTDVIADMLTRIRNANQRYLKTVSVPSSKVKLEIARILKEEGFISDFTVEGDVKKTINIELKYQGKTRVIQGLKKISKPGLRVYAQANEIPQVLNGLGISIVSTSQGIMTGKKARLANAGGEVLAFIW

SEQ ID NO: 1657 - protein, 141 aa, Mycoplasma genitalium
MIINKVPKAHFDPVSDLFTKINNARKAKLLTVTTIASKLKIAILEILIKEGYLANYQVLENKTKTKKLVSFTLKYTQRRICSINGVKQISKPGLRIYRSFEKLPLVLNGLGIAIISTSDGVMTDKVARLKKIGGEILAYVW

SEQ ID NO: 1658 - protein, 132 aa, Mycobacterium leprae
MTMTDPIADFLTRLRNANSAYHDEVTVPHSNIKANIAQILKNEGYIRDFRTEDARVGKSLIIQLKYGPSRERSIAGLRRVSKPGLRVYAKSINLPRVLGGLGVVIISTSSGLLTDRQAARQGVGGEVLAYVW

SEQ ID NO: 1659 - protein, 142 aa, Mycoplasma pneumoniae
MITTTKPIKAHFDPVADLLTKINNARKAKLMTVTTIASKLKIAILEILVKEGYLANFQVLENKSKTKRIVTFNLKYTQRRIPSINGVKQISKPGLRIYRPFEKLPLVLNGLGIAIISTSDGVMTDKVARLKKIGGEILAYVW

SEQ ID NO: 1660 - protein, 133 aa, Sulfolobus acidocaldarius
MPSINPLANALATLYNNEMRRNKQALITPASKLIISVLRVMQKEGYIGEFEYIDDGRAGKIIVQLLGRINKCGPISPRYPLDYNGLLRLPDYIRKYLPSKEIGIIIISTPKGVMSHRDGIREKIGGVTLGYVY

SEQ ID NO: 1661 - protein, 133 aa, Synechococcus sp. (strain PCC 6301)
MAVNDPIADMLTRIRNASEARHATTVVPASRLARSIAEVLKREGFIADFEESGEGVQRHLVLSLKYKGKNQQPIIKALKRVSKPGLRVYSNRRDLPRVLGGIGIAIISTSQGIMTDRDARRQGVGGEVLCYVW

SEQ ID NO: 1662 - protein, 133 aa, Synechocystis sp. (strain PCC 6803)
MASTDTISDMLTRIRNACAVRHSTTQVPTTKMTLSIAKVLKSEGFIEDYSETGEGINKMLVLTLKYKGKTRQPLINTLQRVSKPGLRVYSPSKKIPRVLGGIGIAIVSTSHGIMTDREARRQGIGGEILCYIW

SEQ ID NO: 1663 - protein, 138 aa, Thermus aquaticus (subsp. thermophilus)
MLTDPIADMLTRIRNATRVYKESTEVPASRFKEEILKILAREGFIKGYERVEVDGKPYLRIHLKYGPRRQGPDPRPEQVIKHIRRISRPGRRVYVGVKEIPRVRRGLGIAILSTPKGVLTDREARKLGVGGELICEVW

SEQ ID NO: 1664 - protein, 129 aa, Methanococcus jannaschii
MSVWQGRSRRKPTGGLYRPARKKRKYEMGREPIETHVAEEAFKIKKVRTRGGNLKVKVVRTGFANVLDPETGTCKKVKIITVRENKANIHYVRRNVITKGAIIETEIGLAKVTSRPGQDGTVNAILIKE

SEQ ID NO: 1665 - protein, 129 aa, Bacillus stearothermophilus
AQVQYYGTGRRKSSVARVRLVPGDGRIIVNKQDIREYIPTEALIEMVKQPLVLTETLGSYDVLVNVHGGGFAGQAGAIRHGIARALLQVDPEFRTVLKRAGLLTRDARVKERKKYGLKGARRAPQFSKR

SEQ ID NO: 1666 - protein, 129 aa, Bacillus subtilis
AQVQYYGTGRRKSSVARVRLVPGEGRIVVNNREISEHIPSAALIEDIKQPLTLTETAGTYDVLVNVHGGGLSGQAGAIRHGIARALLEADPEYRTTLKRAGLLTRDARMKERKKYGLKGARRAPQFSKR

SEQ ID NO: 1667 - protein, 129 aa, Escherichia coli
AENQYYGTGRRKSSAARVFIKPGNGKIVINQRSLEQYFGRETARMVVRQPLELVDMVEKLDLYITVKGGGISGQAGAIRHGITRALMEYDESLRSELRKAGFVTRDARQVERKKVGLRKARRRPQFSKR

SEQ ID NO: 1668 - protein, 129 aa, Haemophilus somnus
AENQNYGTGRRKSSSARVFIKPGSGKIVINQRELDVYFGRETSRMIVRQPLELVELTDKLDLYVTVKGGGISGQAGAIRHGITRALIEYDETLRPALRAAGFVTRDARRVERKKIGLHKARRRPQYSKR

SEQ ID NO: 1669 - protein, 129 aa, Helicobacter pylori
MRKIYATGKRKTAIAKVWLTPGKGELSINEQSLNQWLGGHEAIKMKVMQPLLLTKQEQSVDIKAVVFGGGYSAQAEALRHGISKALNAYDIAFRAILKPKGLLTRDSRVVERKKYGKRKARRSPQFSKR

SEQ ID NO: 1670 - protein, 136 aa, Methanococcus jannaschii
MGKIVITVGKRKRAIARAVAREGKGRIRINKIPIELIEPKYKRMKLMEPILLAGEEVISQMDIDVTVKGGGVMGQMDAARTAIGKAIVEFTGSKELRDKFLAYDRTLLVSDARRTEPHKPSRSTKGPRAKRQKSYR

SEQ ID NO: 1671 - protein, 132 aa, Mycoplasma genitalium
MDKKSFYGLGRRKSSTAKVYLYQSKDKGKITINHRNPSDYFPNKLVIQDMEQPLELTKLKDNFDINVVVKGGGFTGQAGAIRLGIVRALIKFNPDLKKLLKTKKLTTRDKRAKERKKFGLYGARRAPQFTKR

SEQ ID NO: 1672 - protein, 153 aa, Mycobacterium leprae
MTETSEAVEIAVGTPAAKHSESFVFERSIQTVGRRKEAVVRVRLVLGTGKFDLNGRSLEDYFPNKVHQQLIKAPLVTVERTRNFDIFALLHGGGPSGQAGALRLGIARALILASPEDRPALKKAGFLTRDPRSTERKKYGLKKARKAPQYSKR

SEQ ID NO: 1673 - protein, 132 aa, Mycoplasma pneumoniae
MEKQSYYGLGRRKSSSAKVYLTPTQDKGKITVNRRDPSEYFPNKLVIQDMEQPLDLTDLKKNFDINVVVKGGGFTGQAGAIRLGIVRALLQFNPELKKILKSKKLTTRDKRVKERKKFGLYGARRAPQFTKR

SEQ ID NO: 1674 - protein, 151 aa, Mycobacterium tuberculosis
MTETTPAPQTPAAPAGPAQSFVLERPIQTVGRRKEAVVRVRLVPGTGKFDLNGRSLEDYFPNKVHQQLIKAPLVTVDRVESFDIFAHLGGGGPSGQAGALRLGIARALILVSPEDRPALKKAGFLTRDPRATERKKYGLKKARKAPQYSKR

SEQ ID NO: 1675 - protein, 103 aa, Prochlorococcus marinus
MNSSSKNAVVYWGTGRRKTSVARVRLIPGTGKITINGRPGDHYLNFNPAYLSAVKAPLHTLGLGEAYDVLVNVYGGGLTGQSDAIKQGAARALCELSVDNRKL

SEQ ID NO: 1676 - protein, 170 aa, Streptomyces coelicolor
MAETTPEQPLEEIDIDSYTTESEVPVEGEYTSESMASAFGEPQPAAGLGRRKNAIARVRIVPGTGKWKVNGRTLEDYFPNKVHQQEVNEPFKVLELDNRYDVIARISGGGVSGQAGALRLGVARALNEADVDNNRGALKKAGYLKRDDRAVERKKAGLKKARKAPQYSKR

SEQ ID NO: 1677 - protein, 130 aa, Sulfolobus acidocaldarius
MITYARRSSARASCYIKPGNGKVFVNDIPIEIIPIEVVRYKIMEPLVLAVDKITSSIEARIYTQGGGIMGQADAARMAHARALVKFTNSKELVEIYKSYDRTMLAGDPRQTESEKWMRYSARRWRQKAYR

SEQ ID NO: 1678 - protein, 140 aa, Sulfolobus solfataricus
MEWMSEEQKLVISSARRKTARATCYIYAGKGRVFVNNVPIELIPIEMVRLKIMEPLLLAGNDIRSKIDAKIITYGGGIMGQADAARMALARALVKFTGSKELEKIYRAYDRTMLAGDPRQTESEKWMRYSARRWRQKSYR

SEQ ID NO: 1679 - protein, 137 aa, Synechocystis sp. (strain PCC 6803)
MQANDSSNKVVYWGTGRRKAAIARVRLVPGQGEVIVNGKPGEIYFNRIANYIQSLKAPLETLGLEGEYNILVNAHGGGLTGQADAVKLGVARALCQLSPENRQPLKAEGYLTRDPRAKERKKYGLHKARKAPQYSKR

SEQ ID NO: 1680 - protein, 26 aa, Thermus aquaticus (subsp. thermophilus)
GKGDRRTRRGKIWRGTYGKYRPRKKK

SEQ ID NO: 1681 - protein, 121 aa, Saccharomyces cerevisiae
MSDFQKEKVEEQEQQQQQIIKIRITLTSTKVKQLENVSSNIVKNAEQHNLVKKGPVRLPTKVLKISTRKTPNGEGSKTWETYEMRIHKRYIDLEAPVQIVKRITQITIEPGVDVEVVVASN

SEQ ID NO: 1682 - protein, 115 aa, Saccharomyces cerevisiae
MGNFRFPIKTKLPPGFINARILRDNFKRQQFKENEILVKSLKFIARNMNLPTKLRLEAQLKLNALPNYMRSTQIKNRCVDSGHARFVLSDFRLCRYQFRENALKGNLPGVKKGIW

SEQ ID NO: 1683 - protein, 148 aa, Arabidopsis thaliana
MGGLDGEQKLLIKKLVNFRMKEGKRTRVRAIVYQTFHRPARTERDVIKLMVDAVENIKPICEVAKVGVAGTIYDVPGIVARDRQQTLAIRWILEAAFKRRISYRISLEKCSFAEILDAYQKRGSARRKRENLHGLASTNRSFAHFRWW

SEQ ID NO: 1684 - protein, 148 aa, Triticum aestivum
MGDFDGEQKELIKKLVNFRMIDGKRTRVRAIVYKTFHRLARTERDVIKLMVDAVDNIKPICEVVKVGVAGTIYDVPGIVARDRQQTLAIRWILGAAFKRRISYRISLEKCSFAEILDAYRKRGISRKRRENLHGLASTNRSFAHFRWW

SEQ ID NO: 1685 - protein, 127 aa, Acanthamoeba castellanii
MSLLSNMISIVKVGYNARHLQVIVQNSKLCINVLSVLYKLGYIRGFIIKDQKNITILLKYINNKPAVRNIAVISTPGRRTYLKHKKLEKFLTKKDSGFLILSTSKGILTDEESNMFKIGGEALLKIN

SEQ ID NO: 1686 - protein, 152 aa, Marchantia polymorpha
MHTLSNLLSSIKNAQKAQKRVLYFSSFKKISKRKKRFVCSACKMMPRVFVSRLCWDFCRILYNEGYIHGFSQEADGSLRIVLKYHSSGIGVIKKMKTISKPGFRIYSSKNRLSKKREGLGITILSTSKGNLICDREAQKTNFGGGEILCQVF

SEQ ID NO: 1687 - protein, 132 aa, Schizosaccharomyces pombe
MLDENGMSITKGKRKSSKATVKMLPGTGKFYVNGSPFDVYFQRMVHRKHAVYPLAACNRLTNYNVWATVHGGGPTGQSGAVHAAISKSLILQEPSLKQVIKDTHCVLNDKRKVERKKTGQPKARKKYTWVKR

SEQ ID NO: 1688 - protein, 102 aa, Marchantia polymorpha
MTAKICIVIKSFENQRSGLLLNTRKIGLPKKQTLYTVLRSPHIDKKSREQFEMRIHKQLLVIETETHKLREKLNWLKLHDLLGVQVKIIFYYQTRLDKVCKS

SEQ ID NO: 1689 - protein, 110 aa, Pisum sativum
MTTKIRIVIRSFDHPFLENHFGGLPPYTWKIGLPESRVLYTVLRSPHIDKKSREQFEMEIKKKYLVIKTEKHELRKKFFWLKRQRLFGAQYEILFFCKTRSDKGKLQRLL

SEQ ID NO: 1690 - protein, 107 aa, Prototheca wickerhamii
MQQVQLKLKSFDPVYINQLISLLNDVLDTLEIQNSKEIFLPSKIKKITVIRSPHIHKKSRDQFQIKRYKRSMIISFTNIDILHAFLEICKDLHVVGVQIHISVKYHS

SEQ ID NO: 1691 - protein, 116 aa, Chondrus crispus
MENKSKLIVLSILFTPNNILYYATQLNGNIIFWTSSGVHKQKNTKKVTLISITTVINYIKYKSVNYKGIHIRTKGFSKNKKLVIKQLKQSTLNILSISDKISWPHNGCKKRKIRRI

SEQ ID NO: 1692 - protein, 125 aa, Marchantia polymorpha
MQKKHGITNMQKKHCITYIQSTFGNTIITLTDYNGNTKTWSSSGSVGFKGSRRSTNYAAQATAENAARVAIQLGFKFVEVRIKGLGYGKESSLRGLKLGGLIITKIRDVTPTPHNGCRPPKKRRV

SEQ ID NO: 1693 - protein, 128 aa, Prototheca wickerhamii
MLVKKSQISRKFIEKKSGIVHIQSTTNNTLITLTDLEGNTQFFVSAGTLGFKNSRKSTVYASGAAAEALASKAFNEGYRTIIVKIKGLGYGKKSAIRGLQKSNLVIKQIQEVTPIAHNGCRPPKKRRV

SEQ ID NO: 1694 - protein, 127 aa, Acanthamoeba castellanii
MPTYHQILKNPRRKKMHTNNVKALEGCPQKKGVCVKLRIVKPKKPNSAQRKVAKLRLSTRRMIIAYIPGQGHNLQEYSSVLVSGGRAPDLPGVRYTLIKGKYDFSWKESFERKKKLSKYGYSTKKKF

SEQ ID NO: 1695 - protein, 125 aa, Allium cepa
MPTFNQLIRHGREEKRRTDRTRALDQCPQKQGVCLRVLTITPKKPNSALRKIAKVRLTNRHDIFAYIPGEGHNSQEHSIVLVRGGRVKDLPGVKFHCIRGVKDLLGIPDRRRGRSKYGAEKPKSK

SEQ ID NO: 1696 - protein, 125 aa, Arabidopsis thaliana
MPTFNQLIRHGREEKRRTDRTRALDKCPQKTGVCPRVSTRTPKKPNSAPRKIAKVRLSNRHDIFAHIPGEGHNSQEHSTVLIRGGRVKDSPGVKSHCIRGVKDLMGIPGRRRGRSKYGAEKPKSI

SEQ ID NO: 1697 - protein, 125 aa, Brassica napus
MPTFNQLIRHGREEKRRTDRTRALDKCPQKLGACPRVSTRTPKKPNSAPRKIAKVRLSNRHDIFAHIPGEGHNSQEHSQVLIRGGRVKDSPGVKSHCIRGVKDLMGIPGRRRGRSKYGAEKPKSI

SEQ ID NO: 1698 - protein, 126 aa, Chlorarachnion sp. (strain CCMP 621)
MATSNQMGANTRSKKKKKNLKKALLGCPQKRGVCMRLLTRSPKKPNSAQRRVAKVRLSTKRVIFAHIPGEGHNLSPFSVVLVRGGNVRDLPGVRYKTIRGVKDLAPVLSRTNGRSKYGTKRPKVHT

SEQ ID NO: 1699 - protein, 127 aa, Chondrus crispus
MPTFKQLLKKPRKIVLTKSKSIALIQCPQKKGICMKVYTTSPKKPNSAERKVAKVNLTNGKSIIGYISGEGHTLQEHSLVLVRGGRVKDLPGVQYHFVRGVYDLHAVGTRKKSRSKYGKKLFKAPIV

SEQ ID NO: 1700 - protein, 140 aa, Drosophila melanogaster
MNFLRQSFGITKQLASQAIQCSYETAVRGMASLQQMHRSGPHIKTRPPRQPLDGKPFAKGVVLKTLIKKPKKPNSANRKCVLVRLSTGKEMVAYIPGIGHNLQEHNIVLCRVGRLQDVPGVKLKAVRGVYDLAHVVKKSQ

SEQ ID NO: 1701 - protein, 125 aa, Helianthus annuus
MPTLNQLIRHGREEKRRTDRTRALDQCPQKQGVCLRVSTRTPKKPNSALRKIAKVRLSNRHDIFAYIPGEGHNLQEHSIVLIRGGRVKDLPGVKFHCIRGVKDLLGIPDRRKGRSKYGAEKPKSR

SEQ ID NO: 1702 - protein, 138 aa, Homo sapiens
MSWSGLLHGLNTSLTCGPALVPRLWATCSMATLNQMHRLGPPKRPPRKLGPTEGRPQLKGVVLCTFTRKPKKPNSANRKCCRVRLSTGREAVCFIPGEGHTLQEHQIVLVEGGRTQDLPGVKLTVVRGKYDCGHVQKK

SEQ ID NO: 1703 - protein, 85 aa, Leishmania tarentolae
MRVLFLYGLCVRFLYFCLVLYFSPRLPSSGNRRCLYAICYMFNILWFFCVFCCVCFLNHLLFIVEGGGFIDLPGVKYFSRFFLNA

SEQ ID NO: 1704 - protein, 125 aa, Magnolia soulangeana
MPTLNQLIRHGREEKRRTDRTRASDQCPQKQGVRPRVPTRTPKKPNSAPRKIAKVRLSNRHDIFAHIPGEGHNSQEHPMVLIRGGRVKDSPGVKSHRIRGVKDLLGIPNRRRGRSKYGAERPKSI

SEQ ID NO: 1705 - protein, 125 aa, Zea mays
MPTKNQLIRHGREEKRRTDRTRALDQCPQKQGVCLRVSTRTPKKPNSALRKIAKVRLSNRHDIFAYIPGEGHNLQEHSIVLVRGGRVKDLPGVKFHCIRGVKDLLGIPDRRKGRSKYGAERPKSK

SEQ ID NO: 1706 - protein, 126 aa, Marchantia polymorpha
MPTMNQLVRKGRESKRRTKRTRALNKCPQKQGVCLRVSTRSPKKPNSALRKIAKVRLTNRNEIIAYIPGEGHNLQEHSVVMVRGGRVQDLPGVKYHCIRGVKDLQGIPGRRRGRSKYGTKKPKDYI

SEQ ID NO: 1707 - protein, 139 aa, Mus musculus
MSWPGLLYGLTTSLSRGLALAPQLWAARSMATLNQMHRLGPRKEPPKRLGPTEGRPQLKGVVLRTFIRKPKKPNSANRKCCRVRLSTGKEAVCFIPGEGHTLQEHHVVLVEGGRTQDLPGVKLKVVRGKYDCGHVQKKK

SEQ ID NO: 1708 - protein, 125 aa, Nicotiana sylvestris
MPTKNQLIRHGREEKRRTDRTRALDQCPQKQGVCPRVSTRTPKKPNSAPRKIAKVRLSNRHDIFAHIPGEGHNSQEHSMVLIRGGRVKDSPGVKFHCIRGVKDLLGIPDRRRGRSKYGAEKPKSI

SEQ ID NO: 1709 - protein, 125 aa, Oryza sativa
MPTKNQLIRHGREEKQRTDRTRASDQCPQKQGVCLRVSTRTPKKPNSALRKIAKVRLSNRHDIFAHIPGEGHNSQEHSIVLVRGGRVKDSPGVKSHRIRGVKDLLGIPDRRKGRSKYGAERPKSK

SEQ ID NO: 1710 - protein, 125 aa, Panax ginseng
MPTLNQLIRHGREEKRRTDRTRASDQCPQKQGVRPRVPTRTPKKPNSAPRKIAKVRLANRHDIFPHIPGEGHNSQEHSMVLIRGGRVKDSPGVKSHCIRGVKDLLGIPDRRRGRSKYGAEKPKSI

SEQ ID NO: 1711 - protein, 139 aa, Paramecium tetraurelia
MLSTLYQNDLKKKRNRRRNRSAALVCCPQKEGSVLKPRIVTPKKPNSARRPVAKAKLTNKKFVVAHIPGTGHNLRKHSTILVRGGGCRDLPGVRHTCIRGVSDFLGVRDKTKRRSIYGIKRPPEMAKRVRRKFRAIFGQ

SEQ ID NO: 1712 - protein, 125 aa, Petunia hybrida
MPSLNQLIRHGREEKRRTDRTRALDQCPQKQGVCPRVSTRTPKKPNSAPRKIAKVRLSNRHDIFAHIPGEGHNLQEHSMVLIRGGRVKDSPGVKSHCIRGVKDLLGIPDRRRGRSKYGAEKPKSI

SEQ ID NO: 1713 - protein, 125 aa, Pinus sylvestris
MPTSNQSIRHGREKKRRTDRTRALEKCPQKRGVCLRVSTRTPKKPNSALRKIAKVRLSNRHDIFAYIPGEGHNLQEHSMVLIRGGRVKDLPGVKFHRIRGVKDLLGIPGRKRGRSKYGAERPKSK

SEQ ID NO: 1714 - protein, 125 aa, Prototheca wickerhamii
MPTINQLLRKKSSRQAPKLKSKKPALAGCPQKRGVCFRVYTRTPKKPNSALRKVAKIRLCNGIVVIASIPGEGHNLQEHSVVCIRGGRVKDLPGVKYKVVRGRLDLQGVVNRKQSRSLYGTPKSK

SEQ ID NO: 1715 - protein, 125 aa, Raphanus sativus
MPTLNQLIRHGREEKRRTDRTRALDKCPQKLGACPRVSTRTPKKPNSAPRKIAKVRLSNRHDIFAHIPGEGHNSQEHSQVLIRGGRVKDSPGVKSHCIRGVKDLMGIPGRRSGRSKYGAEKPKSI

SEQ ID NO: 1716 - protein, 87 aa, Trypanoplasma borreli
MLFYCVLLYGLCLRFLLFSFRYFMCPRLPSSGNRMIGCLLLLLFYSFWLLRCFFIFFLVSCFIYVVEGGGFIDLPSLRYFTRLFYFV

SEQ ID NO: 1717 - protein, 119 aa, Acanthamoeba castellanii
MKKLQNFNTFVSDNKNKNIFSALKDIHGVNLKKINKMGLVMGLDKFEKVSSMNFELFSLIKKQAIFFYNLEENKIFNNVNKKKKIKNYTGMRHILKLPVRGQRTHTNAKTPSKNIKKEL

SEQ ID NO: 1718 - protein, 116 aa, Daucus carota
MLYISGARLVADKQVRIALTKMYGIGPKKAIQVCYRLGISGNIKIKELTKYQIDQMEQMIGQDHVVHWELKRGERADIERFISISCYRGIRHQDGLPLRGQRTHTNARTCRKQIRK

SEQ ID NO: 1719 - protein, 129 aa, Zea mays
MSYISGARSLPDEQVRIASTKMDGIGPKKAIQLRYRLGISGNIKIHELTKYQIDQIEQMIAQDHVVHWELKRGERADIERLISISRYRGIRHQDGSPLRGQRTHTNARTARKQIWKGNERRLPKEQATD

SEQ ID NO: 1720 - protein, 120 aa, Marchantia polymorpha
MSYILGTNLNSNKQVKIALTRIFGIGPKKAIQVCDQLGLSDTIKVNKLTKYQFDQILKIISQNYLVDSELKRVIQRDIKRLISIGCYRGFRHNAGLPLRGQRTHTNAKTCRKLRYVSIRS

SEQ ID NO: 1721 - protein, 114 aa, Oenothera bertiana
MSYISGARLVADEQVRIASTKMDGIGPKKAIQVRSRLGGNIKRKELTKYQIDQIEQMRGQDHVVHWELKRGERADIERFISISCYRGIRHQDGLPLRGQRSHTNARTSRKRIRK

SEQ ID NO: 1722 - protein, 119 aa, Prototheca wickerhamii
MVYIQNTHLNDKKQIYQACAQIYGLGHHHCLQICDVLGVSPETRLGMLSTGQHTLLAQIITQNYDTGSDVRRFTRQNIQRLVNIHSYRGYRHIQGLPVRGQRSHGNARTVRKLKNVIKI

SEQ ID NO: 1723 - protein, 116 aa, Nicotiana tabacum
MLYISGARLVGDEQVRIASTKIDGIGPKKAIQVRYRLGISGNIKIKELTKYQIDQIEQMIGQDHVVHWELKRGERADIERLISISCYRGIRHQDGSPLRGQRTHTNARTCRKLIRK

SEQ ID NO: 1724 - protein, 116 aa, Triticum aestivum
MSYISGARSLPDEQVRIASTKMDGIGPKKAIQLRYRLGISGNIKMNELTKYQIDQIEQMIAQDHVVHWELKRGERADIERLISISRYRGIRHQDGSPLRGQRTHTNARTARKQIRK

SEQ ID NO: 1725 - protein, 99 aa, Acanthamoeba castellanii
MKYLLIKNKKLYKLFFKFELKRLQYKSVMLNTRLPNYIRQKAFMYINKLDKNTSYVAIKQRCFLSNNGRSVLNHFKLSRIKLRLLISNNYVNGVKKFNK

SEQ ID NO: 1726 - protein, 100 aa, Brassica napus
MSEKQNSRDHKRRLLAAKFELRRKLYKAFCKDPDLPSDMRDKHRYKLSKLPRNSSFARVRNRCISTGRPRSVSEFFRIYRIVFRGLASRGSLMGIKKSSW

SEQ ID NO: 1727 - protein, 103 aa, Caenorhabditis elegans
MTFWASWRQLRDVKRREQIQEVGADRMRLKAIKFNTILPQAIRDEAAEKMQKARKYDHPRLILNMCQFTGRQRGKIKPYRLSRHLFRRFADRSALSGVQRAMW

SEQ ID NO: 1728 - protein, 99 aa, Marchantia polymorpha
MSNQIIRDHKRRLLVAKYELKRMHYKAICQDRNLPNKIRYEYFFKLSKLPRNSSKTRVRNRCIFTGRPRSVYKLFRISRIVFRELASKGSLIGINKSCW

SEQ ID NO: 1729 - protein, 99 aa, Oenothera bertiana
MEKRNIRDHKRRLLATKYELRRKLYKAFCNDPALPSDMRDKHRYKLSKLPRNSSFARVRNRCISTGRPRSVYEFFRISRIVFRGLASRGPLMGIKKSSW

SEQ ID NO: 1730 - protein, 102 aa, Paramecium tetraurelia
MIIKLSLINIEFLKRMRYRDFEKKRKILECLKKNQNQAKQLRNHLWQLKVSKNNKSRLTKQVDRCCLTGRTKAYIKNFNLSRHAANLHAFEGLLQNTKTKSW

SEQ ID NO: 1731 - protein, 99 aa, Prototheca wickerhamii
MFNSIKRDLKRRKLYKKYESKRLLYKALISDCNLNQDLRFILTQKLNKLPRNSSQVRVKNRCILTGRGHSVYKFCRISRIKFRDLANQGLIQGCVKSSW

SEQ ID NO: 1732 - protein, 100 aa, Vicia faba
MSEKRNIRDHKRRLLAAKYELRRKLYKAFCKDSDLPSDMRDKLRYKLSKLPRNSSFARVRNRCISTGRPRSVYELFRISRIVFRSLASRGPLMGIKKSSW

SEQ ID NO: 1733 - protein, 131 aa, Saccharomyces cerevisiae [sequence omitted]

SEQ ID NO: 1734 - protein, 78 aa, Acanthamoeba castellanii
MRSVWKGCFYKNNNNGLSKSSTVINTMLKKKFTLHDGKSYKSILIDRSMVGLKIGEFVFTRKMGVLHKKKVLKKKGKK

SEQ ID NO: 1735 - protein, 93 aa, Marchantia polymorpha
MTRSIWKGPFVDTCLFKQKKIRWRIWSRRSCILPQFVGCYAQIYNGKGFVGLKITEEMVGHKFGEFASTRKTSSLGKRALPSKTKIKPIKKVR

SEQ ID NO: 1736 - protein, 94 aa, Petunia hybrida
MPRRSIWKGSFVDAFLLRMKKKRDLLFNRKIWSRRSSILPEFVDCFVRIYNGKTFVRCKITEGKVGHKFGEFAFTRKRRPSRTNIGPGRKRGKK

SEQ ID NO: 1737 - protein, 83 aa, Platymonas subcordiformis
MSRAIWKGPFIDPFFFRKNGSSNSNNKIYSRRSVVSPKFIGREVEIYNGHKWITIKIKEDMIGHKFGEFAFTRKATIHKKKTK

SEQ ID NO: 1738 - protein, 78 aa, Prototheca wickerhamii
MARSLSKPPFCEVKLATNNSVTKIWSRRSAILPQFVGKTVSIHNGRIFIPCKISPEMIGHKFGEFAVTRKKPIHKKKK

SEQ ID NO: 1739 - protein, 107 aa, Neurospora crassa
MVLKLRLARFGRTNAPFYNIVVAHARTARNSKPLEVIGTYDPVPKKDTYDTTGKLHKDIKLDVTRAKYWIGVGAQPTDTVWRLLSLVGILDPKYKKPQPAQEQKTKA

SEQ ID NO: 1740 - protein, 123 aa, Saccharomyces cerevisiae
MIATPIRLAKSAYEPMIKFVGTRHPLVKHATEVVVHPCATNGMLPGSKECIPVSKFMENYKPFRVVPIKHSANAGLSSSKTSVFVNRPLQKDELASIFELPARFRYKPINEHELESINSGGAW

SEQ ID NO: 1741 - protein, 84 aa, Bacillus subtilis
MFMSYDKVSQAKSIIIGTKQTVKALKRGSVKEVVVAKDADPILTSSVVSLAEDQGISVSMVESMKKLGKACGIEVGAAAVAIIL

SEQ ID NO: 1742 - protein, 134 aa, Schizosaccharomyces pombe
MSVSNDLIWQVIRDNNRFLVKRPEFGGIQFNREPVNVSGKNAQRFSGLCNDKAVGVQANSPRGVVLITKTNPKNAQKPAKLFRKDVIANASSRKTYKSIAGRIGRTGYRDDLVKVSVARASAILSSQRPKKTVA

SEQ ID NO: 1743 - protein, 121 aa, Saccharomyces cerevisiae
MAQRVTFRRRNPYNTRSNKIKVVKTPGGILRAQHVKKLATRPKCGDCGSALQGISTLRPRQYATVSKTHKTVSRAYGGSRCANCVKERIVRAFLIEEQKIVKKVVKEQTEAAKKSEKKSKK

SEQ ID NO: 1744 - protein, 87 aa, Escherichia coli
MKPNIHPEYRTVVFHDTSVDEYFKIGSTIKTDREIELDGVTYPYVTIDVSSKSHPFYTGKLRTVASEGNVARFTQRFGRFVSTKKGA

SEQ ID NO: 1745 - protein, 100 aa, Bacillus subtilis
MSGMEWFPLLGLANRARKVVSGEDLVIKEIRNARAKLVLLTEDASSNTAKKVTDKCNYYKVPYKKVESRAVLGRSIGKEARVVVAVTDQGFANKLISLLD

SEQ ID NO: 1746 - protein, 103 aa, Enterococcus faecium
MNEGNRQKAMNLIGLAMRAGKLITGEELTIADIRNEKAKIVFVANDASENTKKKVKDKSSYYEVPCFELFSEAEITQMIGKPRKVFGIVDNGFAKKTKELIEG

SEQ ID NO: 1747 - protein, 105 aa, Saccharomyces cerevisiae
MLMPKQERNKIHQYLFQEGVVVAKKDFNQAKHEEIDTKNLYVIKALQSLTSKGYVKTQFSWQYYYYTLTEEGVEYLREYLNLPEHIVPGTYIQERNPSQRPQRRY

SEQ ID NO: 1748 - protein, 153 aa, Saccharomyces cerevisiae
MLSRFMSNTWCTPLRQAQRLFSSTTTMQATLNQIKRGSGPPRRKKISTAPQLDQCPQRKGVVLRVMVLKPKKPNSAQRKACRVRLTNGNVVSAYIPGEGHDAQEHSIVYVRGGRCQDLPGVKYHVIRGAGDLSGVVNRISSRSKYGAKKPSKS

SEQ ID NO: 1749 - protein, 91 aa, Saccharomyces cerevisiae
MQPAARLLSRSVWKGPNIVPLPIREAMTKGTPIRTNARAATILPQFVGLKFQIHNGKEYVPIEISEDMVGHKLGEFAPTRKRFSYTQTKNK

SEQ ID NO: 1750 - protein, 143 aa, Saccharomyces cerevisiae
MVVHILGKGFKGKEVIKIALASKFYGIGKTTAEKICSKLGFYPWMRMHQLSEPQIMSIASELSTMTIEGDARAIVKDNIALKRKIGSYSGMRHTLHLPVRGQHTRNNAKTARKLNKIDRRGIHTFSQAKVQHNPSLWSCIFGK

SEQ ID NO: 1751 - protein, 158 aa, Saccharomyces cerevisiae
MSQAAKNVIVKLIVGAGQAAPSPPVGPALGSKGIKAIDFCKEFNARSANYQPGVPVPVLITIKPDRTFTFEMKSPPTGYLLLKALKMDKGHGQPNVGTMLGSAPAKGPTRALGELSLKHVYEIAKIKKSDERHSLLEMEGIVKSIVGVAKSMGIKVVP

SEQ ID NO: 1752 - protein, 105 aa, Saccharomyces cerevisiae
MLMPKEDRNKIHQYLFQEGVVVAKKDFNQAKHEEIDTKNLYVIKALQSLTSKGYVKTQFSWQYYYYTLTEEGVEYLREYLNLPEHIVPGTYIQERNPTQRPQRRY

SEQ ID NO: 1753 - protein, 142 aa, Caenorhabditis elegans
MPPATNNSREEKEEETTDVCSANAEKSTKILNCAETHFTLQRRLHFCQLGNSDCGIKAAATIYVNCELLGGAKKRKKKVYTIPKKNNISQRKSSSPSPKYFKIDENGKISRLPTGILTASIQREAFMTQPTTLRKMSQHPCR

SEQ ID NO: 1754 - protein, 136 aa, artificial
  amino acid sequence translation of SEQ ID NO:18 from nt position 106-516
MADNDSPVTLRTRKFIRNPLLGRKQMVVDILHPNRANISKEELREKLGSPYKAQKDQISVFGLRTQFGGGKTTGFALVYDSPEAMKKFEPQYRLVRVGLATKAERASRQQRKQRKNRQKTLRGTAKVKGAKAKKEK

---

What is claimed is:

1. An isolated nucleic acid segment comprising SEQ ID NO:2, wherein said nucleic acid segment encodes an antifungal protein.

2. The isolated nucleic acid segment of claim 1, wherein said antifungal protein is SEQ ID NO:1.

3. The isolated nucleic acid segment of claim 1, wherein said segment is a plant, fungal, or bacterial nucleic acid sequence.

4. A recombinant vector comprising operatively linked in the 5' to 3' direction:

a promoter which functions in a plant cell;

a structural nucleic acid sequence having at least 95% or about 95% sequence identity to SEQ ID NO:2, wherein said nucleic acid sequence encodes an antifungal protein;

a 3' transcriptional termination signal; and a 3' polyadenylation signal.

5. The recombinant vector of claim 4, wherein the promoter is selected from the group consisting of the nopaline synthase (NOS) promoter, octopine synthase (OCS) promoter, mannopine synthase (mas) promoter, cauliflower mosaic virus 19S and 35S (CaMV19S, CaMV35S) promoter, enhanced CaMV (eCaMV) promoter, ribulose 1,5-bisphosphate carboxylase (ssRUBISCO) promoter, figwort mosaic virus (FMV) promoter, CaMV derived AS4 promoter, tobacco RB7 promoter, wheat POX1 promoter, tobacco EIF-4 promoter, lectin protein (Le1) promoter, and rice RC2 promoter.

6. A transformed host cell comprising operatively linked in the 5' to 3' direction:
   a promoter which functions in a plant cell;
   a structural nucleic acid sequence having at least 95% or about 95% sequence identity to SEQ ID NO:2, wherein said nucleic acid sequence encodes an antifungal protein;
   a 3' transcriptional termination signal; and
   a 3' polyadenylation signal.

7. The transformed host cell of claim 6, wherein the structural nucleic acid sequence encodes a protein having at least 95% or about 95% sequence identity to SEQ ID NO:1.

8. The transformed host cell of claim 6, wherein the structural nucleic acid sequence encodes SEQ ID NO:1.

9. The transformed host cell of claim 6, wherein the structural nucleic acid sequence is at least 95% identical to SEQ ID NO:2 and encodes an amino acid sequence variant of SEQ ID NO:1 selected from the group consisting of SEQ ID NO:19, SEQ ID NO:20, SEQ ID NO:21, SEQ ID NO:22, SEQ ID NO:23, and SEQ ID NO:24.

10. The transformed host cell of claim 6, wherein the promoter is seed selective, tissue selective, constitutive, or inducible.

11. The transformed host cell of claim 6, wherein the promoter is selected from the group consisting of the nopaline synthase (NOS) promoter, octopine synthase (OCS) promoter, mannopine synthase (mas) promoter, cauliflower mosaic virus 19S and 35S (CaMV19S, CaMV35S) promoter, enhanced CaMV (eCaMV) promoter, ribulose 1,5-bisphosphate carboxylase (ssRUBISCO) promoter, figwort mosaic virus (FMV) promoter, CaMV derived AS4 promoter, tobacco RB7 promoter, wheat POX1 promoter, tobacco EIF-4 promoter, lectin protein (Le1) promoter, and rice RC2 promoter.

12. The transformed host cell of claim 6, wherein the structural nucleic acid sequence is a synthetic plant, fungal, or bacterial structural nucleic acid sequence.

13. The transformed host cell of claim 12, wherein the transformed host cell is a prokaryotic cell.

14. The transformed host cell of claim 13, wherein the transformed host cell is an *Escherichia coli* cell.

15. The transformed host cell of claim 12, wherein the transformed host cell is a eukaryotic cell.

16. The transformed host cell of claim 15, wherein the transformed host cell is a fungal cell.

17. The transformed host cell of claim 15, wherein the transformed host cell is a plant cell.

18. The transformed host cell of claim 17, wherein the transformed host cell is an alfalfa, apple, banana, barley, bean, broccoli, cabbage, carrot, castorbean, celery, citrus, clover, coconut, coffee, corn, cotton, cucumber, garlic, grape, linseed, melon, oat, olive, onion, palm, parsnip, pea, peanut, pepper, potato, radish, rapeseed, rice, rye, sorghum, soybean, spinach, strawberry, sugarbeet, sugarcane, sunflower, tobacco, tomato, or wheat cell.

19. The transformed host cell of claim 17, wherein a transgenic plant is regenerated from said host cell.

20. The transformed host cell of claim 19, wherein said transgenic plant is an *Acacia*, alfalfa, aneth, apple, apricot, artichoke, arugula, asparagus, avocado, banana, barley, beans, beet, blackberry, blueberry, broccoli, brussels sprouts, cabbage, canola, cantaloupe, carrot, cassava, castorbean, cauliflower, celery, cherry, chicory, cilantro, citrus, clementines, clover, coconut, coffee, corn, cotton, cucumber, Douglas fir, eggplants endive, escarole, eucalyptus, fennel, figs, garlic, gourd, grape, grapefruit, honey dew, jicama, kiwifruit, lettuce, leeks, lemon, lime, Loblolly pine, linseed, mango, melon, mushroom, nectarine, nut, oat, oil palm, oil seed rape, okra, olive, onion, orange, an ornamental plant, palms papaya, parsley, parsnip, pea, peach, peanut, pear, pepper, persimmon, pine, pineapple, plantain, plum, pomegranate, poplar, potato, pumpkin, quince, radiata pine, radicchio, radish, rapeseed, raspberry, rice, rye, sorghum, Southern pine, soybean, spinach, squash, strawberry, sugarbeet, sugarcane, sunflower, sweet potato, sweetgum, tangerine, tea, tobacco, tomato, triticale, turf, turnip, a vine, watermelon, wheat, yam, or zucchini plant.

\* \* \* \* \*